(12) United States Patent
Sivakumar et al.

(10) Patent No.: US 9,441,034 B2
(45) Date of Patent: Sep. 13, 2016

(54) COMPOSITIONS AND METHODS FOR INHIBITING PDGFRβ AND VEGF-A

(75) Inventors: Pallavur V. Sivakumar, Seattle, WA (US); Debra G. Gilbertson, Lake Forest Park, WA (US); Marshall D. Snavely, Redmond, WA (US); George R. Mabry, Seattle, WA (US); Eugene C. Yi, Mill Creek, WA (US); Yue Yao, Issaquah, WA (US); Scott R. Presnell, Tacoma, WA (US)

(73) Assignee: ZYMOGENETICS, INC., Princeton, NJ (US)

( * ) Notice: Subject to any disclaimer, the term of this patent is extended or adjusted under 35 U.S.C. 154(b) by 1634 days.

(21) Appl. No.: 12/934,756

(22) PCT Filed: Mar. 27, 2009

(86) PCT No.: PCT/US2009/038495
§ 371 (c)(1),
(2), (4) Date: Apr. 11, 2011

(87) PCT Pub. No.: WO2009/120922
PCT Pub. Date: Oct. 1, 2009

(65) Prior Publication Data
US 2011/0177074 A1 Jul. 21, 2011

Related U.S. Application Data

(60) Provisional application No. 61/040,068, filed on Mar. 27, 2008, provisional application No. 61/144,547, filed on Jan. 14, 2009.

(51) Int. Cl.
| C07K 16/00 | (2006.01) |
| C07K 16/22 | (2006.01) |
| C07K 16/28 | (2006.01) |
| A61K 39/00 | (2006.01) |

(52) U.S. Cl.
CPC .......... *C07K 16/22* (2013.01); *C07K 16/2863* (2013.01); *A61K 2039/505* (2013.01); *C07K 2317/21* (2013.01); *C07K 2317/31* (2013.01); *C07K 2317/33* (2013.01); *C07K 2317/34* (2013.01); *C07K 2317/55* (2013.01); *C07K 2317/622* (2013.01); *C07K 2317/73* (2013.01); *C07K 2317/76* (2013.01); *C07K 2317/77* (2013.01); *C07K 2317/90* (2013.01); *C07K 2317/92* (2013.01)

(58) Field of Classification Search
None
See application file for complete search history.

(56) References Cited

U.S. PATENT DOCUMENTS

| 5,268,358 A | 12/1993 | Fretto |
| 5,659,013 A | 8/1997 | Senger et al. |
| 5,817,310 A | 10/1998 | Ramakrishnan et al. |
| 5,866,127 A | 2/1999 | Senger et al. |
| 5,872,218 A | 2/1999 | Wolf et al. |
| 5,882,644 A | 3/1999 | Chang et al. |
| 6,235,883 B1 | 5/2001 | Jakobovits et al. |
| 7,227,004 B2 | 6/2007 | Kim |
| 2003/0157108 A1 | 8/2003 | Presta |
| 2003/0228307 A1 | 12/2003 | Ramakrishnan et al. |
| 2004/0018557 A1 | 1/2004 | Qu et al. |
| 2004/0057902 A1 | 3/2004 | Gold et al. |
| 2004/0259156 A1 | 12/2004 | Zhu |
| 2005/0096257 A1 | 5/2005 | Shima et al. |
| 2005/0282233 A1* | 12/2005 | Eriksson et al. ............... 435/7.2 |
| 2006/0234347 A1* | 10/2006 | Harding et al. ............. 435/69.1 |
| 2007/0059302 A1 | 3/2007 | Baca et al. |
| 2007/0141065 A1 | 6/2007 | Fuh et al. |

FOREIGN PATENT DOCUMENTS

| EP | 0666868 | 5/1994 |
| WO | WO 97/37029 | 10/1997 |
| WO | WO9737029 | * 10/1997 |
| WO | WO0075163 | * 12/2000 |
| WO | WO 2004/041867 | 5/2004 |
| WO | WO 2004/096224 | 11/2004 |
| WO | WO 2005/014618 | 2/2005 |
| WO | WO 2005/027972 | 3/2005 |
| WO | WO2005020972 | * 3/2005 |
| WO | WO 2006/020258 | 2/2006 |
| WO | WO2007/073499 | 6/2007 |
| WO | WO 2007/140534 | 12/2007 |
| WO | WO2007/147019 | 12/2007 |
| WO | WO2007140534 | * 12/2007 |
| WO | WO 2008/101985 | 8/2008 |

(Continued)

OTHER PUBLICATIONS

Shen, J., et al., "Single Variable Domain-IgG Fusion—A Novel Recombinant Approach to Fc Domain-Containing Bispecific Antibodies", The Journal of Biological Chemistry, (2006), vol. 281, No. 16, pp. 10706-10714.

Jain, R.K. et al., "Targeting PDGF signaling in carcinoma-associated fibroblasts controls cervical cancer in mouse model," *PLoS Med.*, Jan. 29, 2008;5(1):e24.

Pietras, K. et al., "Functions of paracrine PDGF signaling in the proangiogenic tumor stroma revealed by pharmacological targeting," *PLoS Med.*, Jan. 29, 2008;5(1):e19.

Erber, R. et al., "Combined inhibition of VEGF and PDGF signaling enforces tumor vessel regression by interfering with pericyte-mediated endothelial cell survival mechanisms", The FASEB Journal, vol. 18, No. 2, pp. 338-340 (2004).

(Continued)

*Primary Examiner* — Laura B Goddard
*Assistant Examiner* — Meera Natarajan
(74) *Attorney, Agent, or Firm* — Bing Hai

(57) ABSTRACT

Disclosed are antagonists of PDGF receptor β (PDGFRβ) and VEGF-A, including neutralizing anti-PDGFRβ and anti-VEGF-A antibodies, as well as related compositions and methods. Anti-PDGFRβ and anti-VEGF-A antibodies disclosed herein include bispecific antibodies capable of binding and neutralizing both PDGFRβ and VEGF-A. Also disclosed are methods of treating an neovascular disorder, such as cancer or an neovascular ocular disorder, using a PDGFRβ and/or VEGF-A antagonist.

61 Claims, 9 Drawing Sheets

(56) References Cited

FOREIGN PATENT DOCUMENTS

WO  WO 2008/130704  10/2008
WO  WO 2009/055343  4/2009

OTHER PUBLICATIONS

Jayson, G.C. et al., "Blockade of Platelet-Derived Growth Factor Receptor-Beta by CDP860, a Humanized, PEGylated di-Fab', Leads to Fluid Accumulation and is Associated with Increased Tumor Vascularized Volume", Journal of Clinical Oncology, vol. 23, No. 5, pp. 973-981 (2005).

Jo, N. et al., "Inhibition of Platelet-Derived Growth Factor B Signaling Enhances the Efficacy of Anti-Vascular Endothelial Growth Factor Therapy in Multiple Models of Ocular Neovascularization", American Journal of Pathology, vol. 168, No. 6, pp. 2036-2053 (2006).

Liang, W.-C. et al., "Cross-species Vascular Endothelial Growth Factor (VEGF)-blocking Antibodies Completely Inhibit the Growth of Human Tumor Xenografts and Measure the Contribution of Stromal VEGF", The Journal of Biological Chemistry, vol. 281, No. 2, pp. 951-961 (2006).

Lokker, N.A. et al., "Functional Importance of Platelet-derived Growth Factor (PDGF) Receptor Extracellular Immunoglobulin-like Domains. Identification of PDGF Binding Site and Neutralizing Monoclonal Antibodies", The Journal of Biological Chemistry, vol. 272, No. 52, pp. 33037-33044 (1997).

Shen, J. et al., "An antibody directed against PDGF receptor β enhances the antitumor and the anti-angiogenic activities of an anti-VEGF receptor 2 antibody", Biochemical and Biophysical Research Communications, vol. 357, pp. 1142-1147 (2007).

Shen, J. et al., "Single variable domain antibody as a versatile building block for the construction of IgG-like bispecific antibodies", Journal of Immunological Methods, vol. 318, pp. 65-74 (2007).

Segal, David M., "Introduction: bispecific antibodies" Journal of Immunological Methods, vol. 248, pp. 1-6 (2001).

International Search Report from PCT/US2009/038495 (the corresponding international application of the present application), mailed Oct. 29, 2009.

\* cited by examiner

```
                                    LC                              HC         HC
                                    |                               |          |
                       218          |      222                      |          |  230
wt         |Glu Pro Lys Ser Cys Asp Lys Thr His Thr Cys Pro Pro Cys Pro|
Fc-488     | .   .  Arg  .  Ser  .   .   .   .   .   .   .   .   .   . |
Fc4        | .   .  Arg  .  Ser  .   .   .   .   .   .   .   .   .   . |
Fc5        | .   .   .   .  Ser  .   .   .   .   .   .   .   .   .   . |
Fc6        | .   .   .   .  Ser  .   .   .   .   .   .   .   .   .   . |
Fc7        | .   .   .   .   .   .   .   .   .   .   .   .   .   .   . |
           |                            <- hinge ->                     |

234 235     237                                245
wt         |Ala Pro Glu Leu Leu Gly Gly Pro Ser Val Phe Leu Phe Pro Pro
Fc-488     | .   .   .   .   .   .   .   .   .   .   .   .   .   .   .
Fc4        | .   .   .  Ala Glu  .  Ala  .   .   .   .   .   .   .   .
Fc5        | .   .   .  Ala Glu  .  Ala  .   .   .   .   .   .   .   .
Fc6        | .   .   .  Ala Glu  .  Ala  .   .   .   .   .   .   .   .
Fc7        | .   .   .   .   .   .   .   .   .   .   .   .   .   .   .
           |CH2 ->

260
wt         Lys Pro Lys Asp Thr Leu Met Ile Ser Arg Thr Pro Glu Val Thr
Fc-488      .   .   .   .   .   .   .   .   .   .   .   .   .   .   .
Fc4         .   .   .   .   .   .   .   .   .   .   .   .   .   .   .
Fc5         .   .   .   .   .   .   .   .   .   .   .   .   .   .   .
Fc6         .   .   .   .   .   .   .   .   .   .   .   .   .   .   .
Fc7         .   .   .   .   .   .   .   .   .   .   .   .   .   .   .

275
wt         Cys Val Val Val Asp Val Ser His Glu Asp Pro Glu Val Lys Phe
Fc-488      .   .   .   .   .   .   .   .   .   .   .   .   .   .   .
Fc4         .   .   .   .   .   .   .   .   .   .   .   .   .   .   .
Fc5         .   .   .   .   .   .   .   .   .   .   .   .   .   .   .
Fc6         .   .   .   .   .   .   .   .   .   .   .   .   .   .   .
Fc7         .   .   .   .   .   .   .   .   .   .   .   .   .   .   .

290
wt         Asn Trp Tyr Val Asp Gly Val Glu Val His Asn Ala Lys Thr Lys
Fc-488      .   .   .   .   .   .   .   .   .   .   .   .   .   .   .
Fc4         .   .   .   .   .   .   .   .   .   .   .   .   .   .   .
Fc5         .   .   .   .   .   .   .   .   .   .   .   .   .   .   .
Fc6         .   .   .   .   .   .   .   .   .   .   .   .   .   .   .
Fc7         .   .   .   .   .   .   .   .   .   .   .   .   .   .   .

297                                   305
wt         Pro Arg Glu Glu Gln Tyr Asn Ser Thr Tyr Arg Val Val Ser Val
Fc-488      .   .   .   .   .   .   .   .   .   .   .   .   .   .   .
Fc4         .   .   .   .   .   .   .   .   .   .   .   .   .   .   .
Fc5         .   .   .   .   .   .   .   .   .   .   .   .   .   .   .
Fc6         .   .   .   .   .   .   .   .   .   .   .   .   .   .   .
Fc7         .   .   .   .   .   .  Gln  .   .   .   .   .   .   .   .
```

Fig. 1A

|        |     |     |     |     |     |     |     |     |     |     |     |     |     | 320 |
|--------|-----|-----|-----|-----|-----|-----|-----|-----|-----|-----|-----|-----|-----|-----|
| wt     | Leu | Thr | Val | Leu | His | Gln | Asp | Trp | Leu | Asn | Gly | Lys | Glu | Tyr | Lys |
| Fc-488 | .   | .   | .   | .   | .   | .   | .   | .   | .   | .   | .   | .   | .   | .   | .   |
| Fc4    | .   | .   | .   | .   | .   | .   | .   | .   | .   | .   | .   | .   | .   | .   | .   |
| Fc5    | .   | .   | .   | .   | .   | .   | .   | .   | .   | .   | .   | .   | .   | .   | .   |
| Fc6    | .   | .   | .   | .   | .   | .   | .   | .   | .   | .   | .   | .   | .   | .   | .   |
| Fc7    | .   | .   | .   | .   | .   | .   | .   | .   | .   | .   | .   | .   | .   | .   | .   |

|        |     |     |     |     |     |     |     |     | 330 | 331 |     |     |     | 335 |
|--------|-----|-----|-----|-----|-----|-----|-----|-----|-----|-----|-----|-----|-----|-----|
| wt     | Cys | Lys | Val | Ser | Asn | Lys | Ala | Leu | Pro | Ala | Pro | Ile | Glu | Lys | Thr |
| Fc-488 | .   | .   | .   | .   | .   | .   | .   | .   | .   | .   | .   | .   | .   | .   | .   |
| Fc4    | .   | .   | .   | .   | .   | .   | .   | .   | .   | Ser | Ser | .   | .   | .   | .   |
| Fc5    | .   | .   | .   | .   | .   | .   | .   | .   | .   | Ser | Ser | .   | .   | .   | .   |
| Fc6    | .   | .   | .   | .   | .   | .   | .   | .   | .   | Ser | Ser | .   | .   | .   | .   |
| Fc7    | .   | .   | .   | .   | .   | .   | .   | .   | .   | .   | .   | .   | .   | .   | .   |

|        |     |     |     |     |     |     |     |     |     |     |     |     |     | 350 |
|--------|-----|-----|-----|-----|-----|-----|-----|-----|-----|-----|-----|-----|-----|-----|
| wt     | Ile | Ser | Lys | Ala | Lys\| | Gly | Gln | Pro | Arg | Glu | Pro | Gln | Val | Tyr | Thr |
| Fc-488 | .   | .   | .   | .   | . \| | .   | .   | .   | .   | .   | .   | .   | .   | .   | .   |
| Fc4    | .   | .   | .   | .   | . \| | .   | .   | .   | .   | .   | .   | .   | .   | .   | .   |
| Fc5    | .   | .   | .   | .   | . \| | .   | .   | .   | .   | .   | .   | .   | .   | .   | .   |
| Fc6    | .   | .   | .   | .   | . \| | .   | .   | .   | .   | .   | .   | .   | .   | .   | .   |
| Fc7    | .   | .   | .   | .   | . \| | .   | .   | .   | .   | .   | .   | .   | .   | .   | .   |

<- CH2|CH3 ->

|        |     | 356 |     |     | 358 |     |     |     |     |     |     |     | 365 |
|--------|-----|-----|-----|-----|-----|-----|-----|-----|-----|-----|-----|-----|-----|
| wt     | Leu | Pro | Pro | Ser | Arg | Asp | Glu | Leu | Thr | Lys | Asn | Gln | Val | Ser | Leu |
| Fc-488 | .   | .   | .   | .   | .   | .   | .   | .   | .   | .   | .   | .   | .   | .   | .   |
| Fc4    | .   | .   | .   | .   | .   | .   | .   | .   | .   | .   | .   | .   | .   | .   | .   |
| Fc5    | .   | .   | .   | .   | .   | .   | .   | .   | .   | .   | .   | .   | .   | .   | .   |
| Fc6    | .   | .   | .   | .   | .   | .   | .   | .   | .   | .   | .   | .   | .   | .   | .   |
| Fc7    | .   | .   | .   | .   | .   | .   | .   | .   | .   | .   | .   | .   | .   | .   | .   |

|        |     |     |     |     |     |     |     |     |     |     |     |     |     | 380 |
|--------|-----|-----|-----|-----|-----|-----|-----|-----|-----|-----|-----|-----|-----|-----|
| wt     | Thr | Cys | Leu | Val | Lys | Gly | Phe | Tyr | Pro | Ser | Asp | Ile | Ala | Val | Glu |
| Fc-488 | .   | .   | .   | .   | .   | .   | .   | .   | .   | .   | .   | .   | .   | .   | .   |
| Fc4    | .   | .   | .   | .   | .   | .   | .   | .   | .   | .   | .   | .   | .   | .   | .   |
| Fc5    | .   | .   | .   | .   | .   | .   | .   | .   | .   | .   | .   | .   | .   | .   | .   |
| Fc6    | .   | .   | .   | .   | .   | .   | .   | .   | .   | .   | .   | .   | .   | .   | .   |
| Fc7    | .   | .   | .   | .   | .   | .   | .   | .   | .   | .   | .   | .   | .   | .   | .   |

|        |     |     |     |     |     |     |     |     |     |     |     |     |     | 395 |
|--------|-----|-----|-----|-----|-----|-----|-----|-----|-----|-----|-----|-----|-----|-----|
| wt     | Trp | Glu | Ser | Asn | Gly | Gln | Pro | Glu | Asn | Asn | Tyr | Lys | Thr | Thr | Pro |
| Fc-488 | .   | .   | .   | .   | .   | .   | .   | .   | .   | .   | .   | .   | .   | .   | .   |
| Fc4    | .   | .   | .   | .   | .   | .   | .   | .   | .   | .   | .   | .   | .   | .   | .   |
| Fc5    | .   | .   | .   | .   | .   | .   | .   | .   | .   | .   | .   | .   | .   | .   | .   |
| Fc6    | .   | .   | .   | .   | .   | .   | .   | .   | .   | .   | .   | .   | .   | .   | .   |
| Fc7    | .   | .   | .   | .   | .   | .   | .   | .   | .   | .   | .   | .   | .   | .   | .   |

Fig. 1B

|  |  |  |  |  |  |  |  |  |  |  |  |  |  | | 410 |
|---|---|---|---|---|---|---|---|---|---|---|---|---|---|---|---|
| wt | Pro | Val | Leu | Asp | Ser | Asp | Gly | Ser | Phe | Phe | Leu | Tyr | Ser | Lys | Leu |
| Fc-488 | . | . | . | . | . | . | . | . | . | . | . | . | . | . | . |
| Fc4 | . | . | . | . | . | . | . | . | . | . | . | . | . | . | . |
| Fc5 | . | . | . | . | . | . | . | . | . | . | . | . | . | . | . |
| Fc6 | . | . | . | . | . | . | . | . | . | . | . | . | . | . | . |
| Fc7 | . | . | . | . | . | . | . | . | . | . | . | . | . | . | . |

|  |  |  |  |  |  |  |  |  |  |  |  |  |  | | 425 |
|---|---|---|---|---|---|---|---|---|---|---|---|---|---|---|---|
| wt | Thr | Val | Asp | Lys | Ser | Arg | Trp | Gln | Gln | Gly | Asn | Val | Phe | Ser | Cys |
| Fc-488 | . | . | . | . | . | . | . | . | . | . | . | . | . | . | . |
| Fc4 | . | . | . | . | . | . | . | . | . | . | . | . | . | . | . |
| Fc5 | . | . | . | . | . | . | . | . | . | . | . | . | . | . | . |
| Fc6 | . | . | . | . | . | . | . | . | . | . | . | . | . | . | . |
| Fc7 | . | . | . | . | . | . | . | . | . | . | . | . | . | . | . |

|  |  |  |  | 431 |  |  |  |  |  |  |  |  |  | 440 |
|---|---|---|---|---|---|---|---|---|---|---|---|---|---|---|
| wt | Ser | Val | Met | His | Glu | Ala | Leu | His | Asn | His | Tyr | Thr | Gln | Lys | Ser |
| Fc-488 | . | . | . | . | . | . | . | . | . | . | . | . | . | . | . |
| Fc4 | . | . | . | . | . | . | . | . | . | . | . | . | . | . | . |
| Fc5 | . | . | . | . | . | . | . | . | . | . | . | . | . | . | . |
| Fc6 | . | . | . | . | . | . | . | . | . | . | . | . | . | . | . |
| Fc7 | . | . | . | . | . | . | . | . | . | . | . | . | . | . | . |

|  |  |  |  |  | 446 |  |  |  |
|---|---|---|---|---|---|---|---|---|
| wt | Leu | Ser | Leu | Ser | Pro | Gly | Lys | *** |
| Fc-488 | . | . | . | . | . | . | . | . |
| Fc4 | . | . | . | . | . | . | . | . |
| Fc5 | . | . | . | . | . | . | . | . |
| Fc6 | . | . | . | . | . | . | *** | |
| Fc7 | . | . | . | . | . | . | . | . |

Fig. 1C

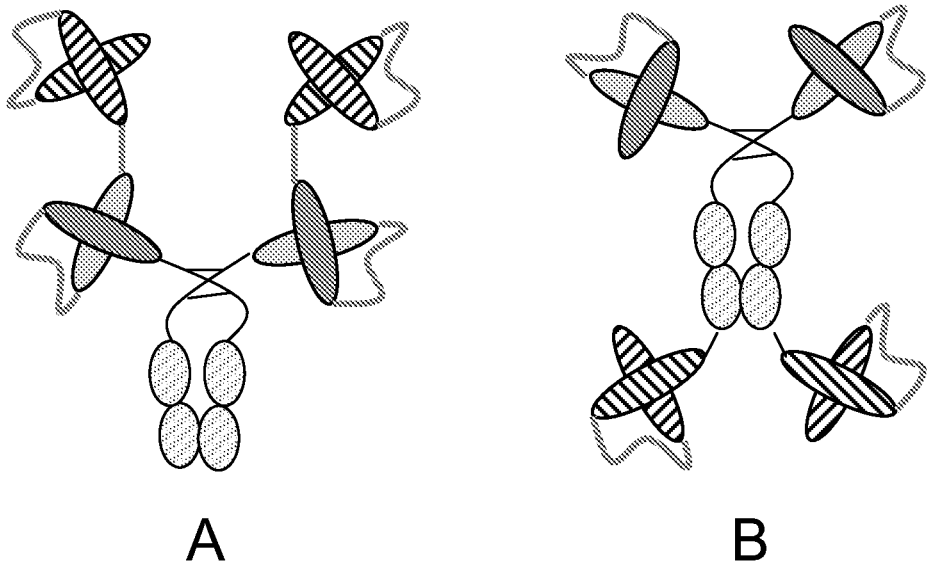
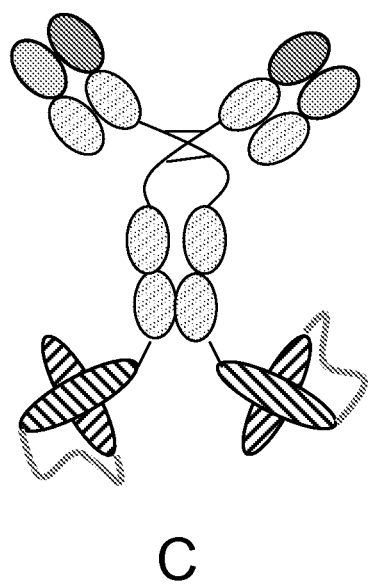
Figs. 2A-2C

COMPOSITIONS AND METHODS FOR INHIBITING PDGFRβ AND VEGF-A

The present application is a national stage application of the International Application No. PCT/US09/38495, filed Mar. 27, 2009, and claims the benefit of U.S. Provisional Application No. 61/144,547, filed Jan. 14, 2009, and U.S. Provisional Application No. 61/040,068, filed Mar. 27, 2008, all of which are incorporated herein by reference in their entirety.

BACKGROUND OF THE INVENTION

I. Angiogenesis

Angiogenesis, also called neovascularization, involves the formation of sprouts from preexistent blood vessels and their invasion into surrounding tissue. During angiogenesis, vascular endothelial cells re-enter the cell cycle, degrade underlying basement membrane, and migrate to form new capillary sprouts. These cells then differentiate, and mature vessels are formed. This process of growth and differentiation is regulated by a balance of pro-angiogenic and anti-angiogenic factors. A related process, vasculogenesis, involves the differentiation of endothelial cells and angioblasts that are already present throughout a tissue, and their subsequent linking together to form blood vessels.

Angiogenesis occurs extensively during development, and also occurs in the healthy body during wound healing in order to restore blood flow to tissues after injury or insult. Angiogenesis, however, has also been implicated in the development of certain diseases, including cancer and tumor formation. Indeed, the quantity of blood vessels in a tumor tissue is a strong negative prognostic indicator in breast cancer (Weidner et al., *J. Natl. Cancer Inst.* 84:1875-1887, 1992), prostate cancer (Weidner et al., *Am. J. Pathol.* 143: 401-409, 1993), brain tumors (Li et al., *Lancet* 344:82-86, 1994), and melanoma (Foss et al., *Cancer Res.* 56:2900-2903, 1996). Angiogenesis has also recently been implicated in other disease states in many areas of medicine, including rheumatology, dermatology, cardiology and ophthalmology. In particular, undesirable or pathological tissue-specific angiogenesis has been associated with certain specific disease states including, for example, rheumatoid arthritis, atherosclerosis, psoriasis, diabetic retinopathy, and macular degeneration. (See, e.g., Fan et al., *Trends Pharmacol. Sci.* 16:57, 1995; Folkman, *Nature Med.* 1:27, 1995.) Furthermore, the alteration of vascular permeability is thought to play a role in both normal and pathological physiological processes (Cullinan-Bove et al., *Endocrinol.* 133:829, 1993; Senger et al., *Cancer and Metastasis Reviews* 12:303, 1993). Although the angiogenic process in each of these diseases is likely to share many features with developmental angiogenesis and tumor angiogenesis, each may also have unique aspects conferred by the influence of surrounding cells.

Multiple molecular mediators of angiogenesis have been identified including basic and acidic fibroblast growth factors (aFGF, bFGF), transforming growth factors alpha and beta (TGFα, TGFβ), platelet-derived growth factor (PDGF), angiogenin, platelet-derived endothelial cell, growth factor (PD-ECGF), interleukin-8 (IL-8), and vascular endothelial growth factor (VEGF). Other stimulators implicated in angiogenesis include angiopoietin-1, Del-1, follistatin, granulocyte colony-stimulating factor (G-CSF), hepatocyte growth factor (HGF), leptin, midkine, placental growth factor, pleiotrophin (PTN), progranulin, proliferin, and tumor necrosis factor-alpha (TNF-alpha). In addition, control of angiogenesis is further mediated by a number of negative regulators of angiogenesis produced by the body including angioarrestin, angiostatin (plasminogen fragment), antiangiogenic antithrombin III, cartilage-derived inhibitor (CDI), CD59 complement fragment, endostatin (collagen XVIII fragment), fibronectin fragment, gro-beta, heparinases, heparin hexasaccharide fragment, human chorionic gonadotropin (hCG), interferon alpha/beta/gamma, interferon inducible protein (IP-10), interleukin-12, kringle 5 (plasminogen fragment), metalloproteinase inhibitors (TIMPs), 2-methoxyestradiol, placental ribonuclease inhibitor, plasminogen activator inhibitor, platelet factor-4 (PF4), prolactin 16 kD fragment, proliferin-related protein (PRP), retinoids, tetrahydrocortisol-S, thrombospondin-1 (TSP-1), vasculostatin, and vasostatin (calreticulin fragment).

Among these angiogenic regulators, VEGF appears to play a key role as a positive regulator of the abnormal angiogenesis accompanying tumor growth (reviewed in Brown et al., *Control of Angiogenesis* (Goldberg and Rosen, eds., 1996); Birkhauser et al., *J. Biol. Chem.* 271:603-606, 1996). Furthermore, recently the role of the PDGF family of signaling molecules has been under investigation, since it appears to play a role in the formation, expansion and proper function of perivascular cells, sometimes referred to as mural cells, e.g., vascular smooth muscle, mesangial cells, and pericytes.

II. VEGF-A

VEGF-A (polynucleotide and polypeptide sequences shown in SEQ ID NOs: 1 and 2, respectively) is a secreted, disulfide-linked homodimeric glycoprotein belonging to the VEGF/PDGF (platelet-derived growth factor) group of the cystine-knot superfamily of hormones and extracellular signaling molecules (see Vitt et al., *Mol. Endocrinol.*, 15:681-694, 2001), which are all characterized by the presence of eight conserved cysteine residues forming the typical cystine-knot structure (named after cystine, a dimer of two cysteines linked by a disulfide bond). Five human VEGF-A isoforms of 121, 145, 165, 189 or 206 amino acids in length (VEGF-$A_{121-206}$), encoded by distinct mRNA splice variants, have been described, all of which are capable of stimulating mitogenesis in endothelial cells. These isoforms differ in biological activity, receptor specificity, and affinity for cell surface- and extracellular matrix-associated heparan-sulfate proteoglycans, which behave as low affinity receptors for VEGF-A: VEGF-$A_{121}$ does not bind to either heparin or heparan-sulfate; VEGF-$A_{145}$ and VEGF-$A_{165}$ (GenBank Acc. No. M32977) are both capable of binding to heparin; and VEGF-$A_{189}$ and VEGF-$A_{206}$ show the strongest affinity for heparin and heparan-sulfates. VEGF-$A_{121}$, VEGF-$A_{145}$, and VEGF-$A_{165}$ are secreted in a soluble form, although most of VEGF-$A_{165}$ is confined to cell surface and extracellular matrix proteoglycans, whereas VEGF-$A_{189}$ and VEGF-$A_{206}$ remain associated with extracellular matrix. Both VEGF-$A_{189}$ and VEGF-$A_{206}$ can be released by treatment with heparin or heparinase, indicating that these isoforms are bound to extracellular matrix via proteoglycans. Cell-bound VEGF-$A_{180}$ can also be cleaved by proteases such as plasmin, resulting in release of an active soluble VEGF-$A_{110}$.

Most tissues that express VEGF-A are observed to express several VEGF-A isoforms simultaneously, although VEGF-$A_{121}$ and VEGF-$A_{165}$ are the predominant forms, whereas VEGF-$A_{206}$ is rarely detected (see Ferrara, *J. Mol. Med.* 77:527-543, 1999). VEGF-$A_{145}$ differs in that it is primarily expressed in cells derived from reproductive organs (see Neufeld et al., *FASEB J.* 13:9-22, 1999). Human VEGF-$A_{165}$, the most abundant and biologically active form, is glycosylated at Asn74 and is typically expressed as a 46 kDa homodimer of 23 kDa subunits.

Four cell-surface receptors that interact with VEGF-A have been identified. These include VEGFR-1/Flt-1 (fins-like tyrosine kinase-1; GenBank Acc. No. X51602; De Vries et al., Science 255:989-991, 1992); VEGFR-2/KDR/Flk-1 (kinase insert domain containing receptor/fetal liver kinase-1; GenBank Acc. Nos. X59397 (Flk-1) and L04947 (KDR); Terman et al., Biochem. Biophys. Res. Comm. 187:1579-1586, 1992; Matthews et al., Proc. Natl. Acad. Sci. USA 88:9026-9030, 1991); neuropilin-1 (Gen Bank Acc. No. NM003873), and neuropilin-2 (Gen Bank Acc. No. NM003872). $VEGF_{121}$ and $VEGF_{165}$ bind VEGFR-1; $VEGF_{121}$, $VEGF_{145}$, and $VEGF_{165}$ bind VEGFR-2; $VEGF_{165}$ binds neuropilin-1; and $VEGF_{165}$ and $VEGF_{145}$ bind neuropilin-2. See, e.g., Neufeld et al., FASEB J. 13:9-22, 1999; Stacker and Achen, Growth Factors 17:1-11, 1999; Ortega et al., Fron. Biosci. 4:141-152, 1999; Zachary, Intl. J. Biochem. Cell Bio. 30:1169-1174, 1998; Petrova et al., Exp. Cell Res. 253:117-130, 1999.

VEGF-A-driven angiogenesis has a major role in the pathogenesis of diverse human diseases, including cancer, eye disorders, and rheumatoid arthritis. See Carmeliet et al., Nature 407:249-257, 2000. Recognition of the importance of VEGF-A for the development of several important classes of cancer recently culminated in the approval of AVASTIN™, a humanized monoclonal antibody to VEGF-A, for the treatment of metastatic colorectal cancer. See Ferrara et al., Nat. Rev. Drug Discov. 2004, 3:391-400, 2004. Similarly, the importance of VEGF-A in the pathogenesis of neovascular ocular disorders is reflected in the recent approval of LUCENTIS™, a humanized monoclonal antibody fragment, for the treatment of neovascular (wet) age-related macular degeneration (AMD).

III. PDGFRβ

PDGFRβ (platelet-derived growth factor receptor β; polynucleotide and polypeptide sequences shown in SEQ ID NOs. 3 and 4, respectively) is one of two structurally related cell surface receptor tyrosine kinases (PDGFRα and PDGFRβ) mediating the biological activities of various platelet-derived growth factor (PDGF) isoforms-PDGF-A, -B, -C, and -D. PDGFs belong to the PDGF/VEGF (vascular endothelial growth factor) family, which, as previously indicated, is characterized by the presence of eight conserved cysteine residues forming the typical cystine-knot structure. Two forms of the PDGF-A chain, containing 196 and 211 amino acid residues resulting from differential splicing of the transcript, are synthesized, dimerized, proteolytically processed in the N-terminus, and secreted from the cell as a ~30 kDa dimer (Bonthron et al., Proc. Natl. Acad. Sci. USA 85:1492-1496, 1988; Rorsman et al., Mol. Cell. Biol. 8:571-577, 1988). The PDGF-B chain encoding 241 amino acid residues is dimerized, processed by additional proteolysis, and secreted as a 24 kDa dimer (Ostman et al., J. Biol. Chem. 263:16202-16208, 1988; Ostman et al., J. Cell. Biol. 118:509-519, 1992). The A and B chains are capable of forming both homodimers and heterodimers with each other (PDGF-AA, -BB, and -AB). The full-length PDGF-C and -D proteins contain 345 and 370 amino acid residues respectively, and both have a unique two-domain structure with a N-terminal CUB domain and a C-terminal PDGF/VEGF domain. Proforms of PDGF C and D are secreted as an approximately 85 kDa homodimer after cleavage of the N-terminal 22 signal peptide residues. Whereas secreted PDGF-AA, -BB, and -AB can readily activate their cell surface receptors, proteolytic removal of the CUB domain is required for the growth factor domain of PDGF-CC and -DD homodimers to activate the cell surface receptors Both PDGFRs (PDGFRα and PDGFRβ) contain five extracellular immunoglobulin-like domains, a transmembrane domain, a juxtamembrane domain, splitted kinase domains, a kinase insert domain, and a cytoplasmic tail. These two receptors share 31% identity in the ligand binding domain, 27% identity in the kinase insert and 28% identity in the C-terminus, whereas they are 85% and 75% identical in the two halves of the kinase insert domain (Matsui et al., 1989; Rosenkranz and Kazlauskas, 1999). The three dimeric PDGF receptors (αα, αβ, ββ) mediate PDGF isoform-specific signal transduction. PDGF-AA effectively activates only PDGFRαα, PDGF-AB can activate either PDGFRαα or PDGFRαβ, while PDGF-BB activates all three dimeric PDGF receptors (see Claesson-Welsh et al., Mol. Cell. Biol. 8:3476-3486, 1988; Matsui et al., Science 243:800-804, 1989; Claesson-Welsh, J. Biol. Chem. 269, 32023-32026, 1994). The growth factor domain of PDGF-CC activates both PDGFRαα and PDGFRαβ, and the growth factor domain of PDGF-DD activates PDGFRββ and PDGFRαβ (see Li et al., Nature Cell. Biol. 2:302-309, 2000; Bergsten et al., Nature Cell. Biol. 3:512-516, 2001; Gilbertson et al., J. Biol. Chem. 276:27406-27414, 2001; LaRochelle et al., Nat. Cell. Biol. 3:517-521, 2001).

PDGFs produced by endothelial cells in vessels promote recruitment and proliferation of vascular smooth muscle cells/pericyte progenitors expressing PDGFR (Betsholtz et al., 2001). Chemotactic and mitogenic activities mediated by the PDGF/PDGFR paracrine signaling loop are crucial for the formation, branching and maintenance of blood vessels. As in embryogenesis, PDGF plays a critical role for angiogenesis in human tumors. Tumor angiogenesis, required for tumor outgrowth and metastasis, is a complex and highly regulated process involving many different cell types and extracellular factors. Endothelial cells and smooth muscle cells are the major components of blood vessels, and VEGF/PDGF super family members are among the critical mediators of tumor angiogenesis. Clinical studies revealed a correlation between vascular counts and expression frequency of VEGF and PDGF in tumors (Anan et al., Surgery 119:333-339, 1996). PDGFs directly and indirectly stimulate the angiogenic processes. PDGF released by the tumor cells induce migration of endothelial cells and vascular smooth muscle cells (vSMC), and also stimulate proliferation of these cells, suggesting a direct role of PDGFs in angiogenesis (Thommen et al., J. Cell. Biochem. 64:403-413, 1997). PDGFs were shown to induce transcription and secretion of VEGF-A by PDGFR expressing endothelial cells, suggesting an indirect role for PDGF induced angiogenesis (Wang et al., Cancer Res. 59:1464-1472, 1999). PDGFs also mediate the paracrine signaling loop between endothelial cells and vSMC/pericytes during tumor angiogenic processes. While PDGF-BB, -AB, and the growth factor domain of PDGF-CC induce indistinguishable angiogenic responses in mouse cornea assay, PDGF-AA (which binds to PDGFRαα but not PDGFRαβ or PDGFRββ) stimulates only a weak response (Cao et FASEB J. 16:1575-1583, 2002). This suggests that PDGFRα and PDGFβ may differently regulate angiogenic processes, and points to the PDGFRβ subunit in particular as an important mediator of PDGF-induced angiogenesis.

PDGF receptor signaling has been linked to various processes in the disease states described above, including autocrine growth factor signaling in tumor cells, tumor and ocular angiogenesis and recruitment of regulation of stromal cells, namely fibroblasts in the tumor, or ocular disease tissues. Expression of almost all ligands of the PDGF family in NIH3T3 cells leads to transformation of the cell to a cancerous phenotype (Reviewed in Ostman and Heldin, *Adv in Can Res* 97:247-74, 2007). In support of this, co-expression of various PDGF ligands and receptors have been demonstrated in multiple diseases, including various cancers (reviewed in Ostman *Cytokine and Growth Factor Rev* 15:275-86, 2004). Furthermore, mutational activation of PDGF or PDGF receptors have now been shown to be associated with different malignancies, including dermatofibrosarcoma protuberans (DFSP), gastrointestinal stromal tumors (GIST) and Bcr-Abl-negative chronic myeloid leukemias (reviewed in Ostman and Heldin, *Adv. Cancer Res.* 97:247-74, 2007). The PDGF family has also been shown to play a significant role in tumor angiogenesis, especially with respect to recruitment of pericytes and vascular smooth muscle cells to the tumor and ocular vasculature. These mural cells (pericytes and smooth muscle cells) are thought to provide a supportive framework for growing vascular endothelial cells. PDGFRβ has been shown to be essential for the recruitment of pericytes to tumor vasculature and for the differentiation of mesenchymal stem cells to pericytes (Song et al., *Nat. Cell Biol.* 7:870-79, 2005; Bergers et al., *Neuro. Oncol.* 7:452-64, 2005). PDGFR antagonists have shown to inhibit angiogenesis by not only inhibiting pericyte recruitment but also by reducing endothelial cell coverage within tumors (Bergers et al., *J. Clin. Invest.* 111:1287-95, 2003). Furthermore, PDGF and PDGF receptors are expressed significantly in tumor stroma, namely fibroblast cells within various cancers and multiple experiments have demonstrated a critical role for PDGF-BB and PDGFRβ and PDGFRα receptors in stromal cell recruitment within tumors (reviewed in Ostman and Heldin, *Adv. Cancer Res.* 97:247-74, 2007). A series of recent studies indicate a function of these receptors in controlling tumor transvascular transport. Multiple pieces of evidence now support a role for PDGF and PDGFR in controlling interstitial fluid pressure (IFP), a key parameter determining transvascular transport. Most solid tumors are characterized by high IFP leading to decreased convection rate across capillary walls and there reduced uptake of drugs (chemotherapy) by tumors. PDGF receptor antagonists have shown to reduce tumor IFP and thereby allowing for increased drug uptake within tumors, leading to better anti-tumor efficacy (Pietras et al., *Cancer Res.* 62:5476-84, 2002; Pietras et al., *Cancer Res.* 61:2929-34, 2001). PDGFR antagonists therefore provide a method to inhibit multiple processes within the tumor vasculature, including autocrine effects on tumor cells, angiogenesis and affecting IFP mediated by tumor stroma. Combinations with other drugs, namely anti-angiogenec inhibitors like VEGF antagonists and/or chemotherapy may provide additional benefit to cancer patients.

IV. Inhibition of VEGF and PDGF Pathways

Although anti-angiogenic therapies, including AVASTIN™, have been approved for various cancers (and LUCENTIS™ for AMD), efficacy is moderate and patients eventually progress. One factor limiting efficacy is the presence of other angiogenic pathways that are not inhibited by these therapies. In mouse models, it has recently been demonstrated that PDGFRβ-expressing pericytes are found in tumors treated with VEGF antagonists and these provide a framework for newly formed endothelial cells to grow within the tumors (Mancuso et al., *J. Clin. Invest.* 116:2610-21, 2006). Inhibiting both the VEGF and PDGFR pathways may provide additive or synergistic angiogenesis inhibition in disease settings and, in cancer, may provide for enhanced delivery of chemotherapeutics by normalizing vessels and IFP.

Scientific evidence supports this therapeutic approach. Data that shows co-targeting both PDGFR and VEGFR signaling more effectively inhibits growth of endothelial vessels and is more effective at inhibiting tumor growth in preclinical disease models. In a spontaneous pancreatic tumor model (RIP-Tag), Bergers and colleagues demonstrated that combination with a VEGF inhibitor (SU5416) and a PDGF inhibitor (SU6668 or imatinib) inhibited growth of pancreatic adenocarcinomas when administered late during tumor progression (IT or RT), whereas VEGF inhibition alone was only effective when used in early disease settings (PT and IT) (Bergers et al., *J. Clin. Invest.* 111:1287-95, 2003). The decrease in tumor growth was associated with a decrease in tumor associated endothelial cells and pericytes and inhibition of angiogenesis. Similarly, in a pancreatic xenograft model (BxPC-3), treatment with both anti-PDGFRβ and VEGFR2 antibodies showed significant anti-tumor effects when compared to monotherapy treatment regimens (Shen et al., *Biochem Biophys Res Commun* 357: 1142-47, 2007). Pietras and colleagues further demonstrated that efficacy was substantially higher in the Rip-Tag pancreatic model when anti-VEGF and anti-PDGF therapies were combined together with chemotherapy (Pietras and Hanahan, *J. Clin. Oncol.* 23:939-52, 2005). Combination efficacy has also been demonstrated in ovarian carcinoma xenograft models combing PDGFR and VEGFR inhibitors (Lu et al., *Clin. Cancer Res.* 13:4209-17, 2007). These data provide strong proof-of-concept rationale for targeting both pathways in oncology. Furthermore, combination targeting of these pathways also has shown to inhibit neovascularization in a rodent eye model (Jo et al., *Am. J. Pathol.* 168:2036-53, 2006), providing preclinical support for possible efficacy in ocular disease indications, including AMD.

SUMMARY OF THE INVENTION

In one aspect, the present invention provides an antibody that specifically binds to the extracellular domain of PDGFRβ and neutralizes PDGFRβ activity. In some embodiments, a neutralizing anti-PDGFRβ comprises a $V_L$ domain comprising CDRs LCDR1, LCDR2, and LCDR3 and a $V_H$ domain comprising CDRs HCDR1, HCDR2, and HCDR3, where LCDR1 has the amino acid sequence shown in SEQ ID NO: 433; LCDR2 has the amino acid sequence shown in SEQ ID NO: 434; LCDR3 has the amino acid sequence shown in SEQ ID NO: 435; HCDR1 has the amino acid sequence shown in SEQ ID NO: 436; HCDR2 has the amino acid sequence shown in SEQ ID NO: 437; and HCDR3 has an amino acid sequence selected from the group consisting of SEQ ID NOs: 438-442. In some such embodiments, LCDR1 has the amino acid sequence shown in SEQ ID NO: 443; LCDR3 has the amino acid sequence shown in SEQ ID NO: 444; and HCDR1 has the amino acid sequence shown in SEQ ID NO: 445. In other such embodiments, LCDR1 has the amino acid sequence shown in SEQ ID NO: 443; LCDR3 has the amino acid sequence shown in SEQ ID NO: 444; HCDR1 has the amino acid sequence shown in SEQ ID NO: 446; and HCDR2 has the amino acid sequence shown in SEQ ID NO: 447. In some variations, LCDR1 has the amino acid sequence shown in SEQ ID NO: 443; LCDR3 has the amino acid sequence shown in SEQ ID NO: 444; HCDR1 has the amino acid sequence shown in SEQ ID NO: 446; HCDR2 has the amino acid sequence shown in SEQ ID NO: 447; and HCDR3 has an amino acid sequence selected from the group consisting of SEQ ID NOs: 441 and 442.

In other embodiments, a neutralizing anti-PDGFRβ comprises a $V_L$ domain comprising CDRs LCDR1, LCDR2, and LCDR3 and a $V_H$ domain comprising CDRs HCDR1, HCDR2, and HCDR3, where LCDR1 has the amino acid sequence shown in SEQ ID NO: 433; LCDR2 has the amino acid sequence shown in SEQ ID NO: 434; LCDR3 has the amino acid sequence shown in SEQ ID NO: 435; and HCDR1, HCDR2, and HCDR3 have the amino acid sequences shown, respectively, in (a) residues 31-35, residues 50-66, and residues 99-110 of SEQ ID NO: 8; (b) residues 31-35, residues 50-66, and residues 99-110 of SEQ ID NO: 12; (c) residues 31-35, residues 50-66, and residues 99-111 of SEQ ID NO: 24; (d) residues 31-35, residues 50-66, and residues 99-110 of SEQ ID NO: 36; or (e) residues 31-35, residues 50-66, and residues 99-111 of SEQ ID NO: 48.

In other embodiments, a neutralizing anti-PDGFRβ comprises a $V_L$ domain comprising CDRs LCDR1, LCDR2, and LCDR3 and a $V_H$ domain comprising CDRs HCDR1, HCDR2, and HCDR3, where LCDR1 has the amino acid sequence shown in SEQ ID NO: 433; LCDR2 has the amino acid sequence shown in residues 56-62 of SEQ ID NO: 6 or 10; LCDR3 has the amino acid sequence shown in residues 95-103 of SEQ ID NO: 6, 10, or 46; HCDR1 has the amino acid sequence shown in residues 31-35 of SEQ ID NO: 8, 12, 24, 36, or 48; HCDR2 has the amino acid sequence shown in residues 50-66 of SEQ ID NO: 8, 12, 24, 36, or 48; and HCDR3 has an amino acid sequence selected from the group consisting of SEQ ID NOs: 438-442. In some such variations, (a) LCDR2 and LCDR3 have the amino acid sequences shown, respectively, in residues 56-62 and residues 95-103 of SEQ ID NO: 6; and HCDR1, HCDR2, and HCDR3 have the amino acid sequences shown, respectively, in residues 31-35, residues 50-66, and residues 99-110 of SEQ ID NO: 8; (b) LCDR2 and LCDR3 have the amino acid sequences shown, respectively, in residues 56-62 and residues 95-103 of SEQ ID NO: 10; and HCDR1, HCDR2, and HCDR3 have the amino acid sequences shown, respectively, in residues 31-35, residues 50-66, and residues 99-110 of SEQ ID NO: 12; (c) LCDR2 and LCDR3 have the amino acid sequences shown, respectively, in residues 56-62 and residues 95-103 of SEQ ID NO: 22; and HCDR1, HCDR2, and HCDR3 have the amino acid sequences shown, respectively, in residues 31-35, residues 50-66, and residues 99-111 of SEQ ID NO: 24; (d) LCDR2 and LCDR3 have the amino acid sequences shown, respectively, in residues 56-62 and residues 95-103 of SEQ ID NO: 34; and HCDR1, HCDR2, and HCDR3 have the amino acid sequences shown, respectively, in residues 31-35, residues 50-66, and residues 99-110 of SEQ ID NO: 36; (e) LCDR2 and LCDR3 have the amino acid sequences shown, respectively, in residues 56-62 and residues 95-103 of SEQ ID NO: 38; and HCDR1, HCDR2, and HCDR3 have the amino acid sequences shown, respectively, in residues 31-35, residues 50-66, and residues 99-110 of SEQ ID NO: 40; or (f) LCDR2 and LCDR3 have the amino acid sequences shown, respectively, in residues 56-62 and residues 95-103 of SEQ ID NO: 46; and HCDR1, HCDR2, and HCDR3 have the amino acid sequences shown, respectively, in residues 31-35, residues 50-66, and residues 99-111 of SEQ ID NO: 48. In some embodiments, LCDR1 has the amino acid sequence shown in SEQ ID NO: 433; LCDR2 has the amino acid sequence shown in residues 56-62 of SEQ ID NO: 6; LCDR3 has the amino acid sequence shown in residues 95-103 of SEQ ID NO: 6; HCDR1 has the amino acid sequence shown in residues 31-35 of SEQ ID NO: 8 or 12; HCDR2 has the amino acid sequence shown in residues 50-66 of SEQ ID NO: 8 or 12; and HCDR3 has the amino acid sequence shown in residues 99-110 of SEQ ID NO: 8 or 12.

In specific variations of a neutralizing anti-PDGFRβ antibody as above, the $V_L$ and $V_H$ domains comprise the amino acid sequences as shown, respectively, in SEQ ID NOs: 6 and 8; SEQ ID NOs: 10 and 12; SEQ ID NOs: 22 and 24; SEQ ID NOs: 34 and 36; SEQ ID NOs: 38 and 40; or SEQ ID NOs: 46 and 48.

In other embodiments, a neutralizing anti-PDGFRβ comprises a $V_L$ domain comprising CDRs LCDR1, LCDR2, and LCDR3 and a $V_H$ domain comprising CDRs HCDR1, HCDR2, and HCDR3, wherein said set of $V_L$ and $V_H$ CDRs has 3 or fewer amino acid substitutions relative to a second set of CDRs selected from the group consisting of: (a) LCDR1, LCDR2, and LCDR3 having the amino acid sequences shown, respectively, in residues 24-40, residues 56-62, and residues 95-103 of SEQ ID NO: 6; and HCDR1, HCDR2, and HCDR3 having the amino acid sequences shown, respectively, in residues 31-35, residues 50-66, and residues 99-110 of SEQ ID NO: 8; (b) LCDR1, LCDR2, and LCDR3 having the amino acid sequences shown, respectively, in residues 24-40, residues 56-62, and residues 95-103 of SEQ ID NO: 10; and HCDR1, HCDR2, and HCDR3 having the amino acid sequences shown, respectively, in residues 31-35, residues 50-66, and residues 99-110 of SEQ ID NO: 12; (c) LCDR1, LCDR2, and LCDR3 having the amino acid sequences shown, respectively, in residues 24-40, residues 56-62, and residues 95-103 of SEQ ID NO: 22; and HCDR1, HCDR2, and HCDR3 having the amino acid sequences shown, respectively, in residues 31-35, residues 50-66, and residues 99-111 of SEQ ID NO: 24; (d) LCDR1, LCDR2, and LCDR3 having the amino acid sequences shown, respectively, in residues 24-40, residues 56-62, and residues 95-103 of SEQ ID NO: 34; and HCDR1, HCDR2, and HCDR3 having the amino acid sequences shown, respectively, in residues 31-35, residues 50-66, and residues 99-110 of SEQ ID NO: 36; (e) LCDR1, LCDR2, and LCDR3 having the amino acid sequences shown, respectively, in residues 24-40, residues 56-62, and residues 95-103 of SEQ ID NO: 46; and HCDR1, HCDR2, and HCDR3 having the amino acid sequences shown, respectively, in residues 31-35, residues 50-66, and residues 99-111 of SEQ ID NO: 48. In some embodiments, the antibody comprises zero, one, or two amino acid substitutions in said set of CDRs.

In still other embodiments, a neutralizing anti-PDGFRβ antibody comprises a $V_L$ domain comprising CDRs LCDR1, LCDR2, and LCDR3 and a $V_H$ domain comprising CDRs HCDR1, HCDR2, and HCDR3, wherein said set of $V_L$ and $V_H$ CDRs has 3 or fewer amino acid substitutions relative to a second set of CDRs in which LCDR1 has the amino acid sequence shown in residues 24-34 of SEQ ID NO: 18; LCDR2 has the amino acid sequence shown in residues 50-56 of SEQ ID NO: 18; LCDR3 has the amino acid sequence shown in residues 89-97 of SEQ ID NO: 18; HCDR1 has the amino acid sequence shown in residues 31-35 of SEQ ID NO: 20; HCDR2 has the amino acid sequence shown in residues 50-66 of SEQ ID NO: 20; HCDR3 has the amino acid sequence shown in residues 99-115 of SEQ ID NO: 20. In some embodiments, the antibody comprises zero, one, or two amino acid substitutions in said set of CDRs. In certain variations, the antibody comprises zero substitutions in said CDRs. In a specific variations, the $V_L$ domain comprises an amino acid sequence as shown in SEQ ID NO: 18 and the $V_H$ domain comprises an amino acid sequence as shown in SEQ ID NO: 20.

In yet other embodiments, a neutralizing anti-PDGFRβ antibody binds to an epitope comprising one or more amino acids included within a polypeptide region of PDGFRβ as shown in residues 251-270 of SEQ ID NO: 4. Exemplary anti-PDGFRβ antibodies having this epitope specificity include antibodies comprising light and heavy chain variable domains having respective $V_L$ and $V_H$ amino acid sequences selected from the following $V_L/V_H$ sequence pairs: SEQ ID NOs: 6 and 8; SEQ ID NOs: 10 and 12; SEQ ID NOs: 22 and 24; and SEQ ID NOs: 46 and 48. In certain embodiments, the epitope further comprises one or more amino acids included within a second polypeptide region of PDGFRβ as shown in amino acid residues 196-205 or 191-210 of SEQ ID NO: 4. Exemplary anti-PDGFRβ antibodies of this class include antibodies comprising light and heavy chain variable domains having respective $V_L$ and $V_H$ amino acid sequences selected from the following $V_L/V_H$ sequence pairs: SEQ ID NOs: 22 and 24; and SEQ ID NOs: 46 and 48. In certain embodiments, the anti-PDGFRβ epitope is an epitope as determined by peptide microarray epitope mapping comprising the use of overlapping PDGFRβ (SEQ ID NO: 4) 20-mer peptides.

In certain variations, a neutralizing anti-PDGFRβ antibody as above is a bispecific antibody that also binds to VEGF-A. In preferred variations, the bispecific antibody neutralizes VEGF-A.

In another aspect, the present invention provides an antibody that specifically binds to VEGF-A and neutralizes VEGF-A activity. In some embodiments, a neutralizing anti-VEGF-A antibody comprises a $V_L$ domain comprising CDRs LCDR1, LCDR2, and LCDR3 and a $V_H$ domain comprising CDRs HCDR1, HCDR2, and HCDR3, where LCDR1 has the amino acid sequence shown in SEQ ID NO: 448; LCDR2 has the amino acid sequence shown in SEQ ID NO: 449; LCDR3 has the amino acid sequence shown in SEQ ID NO: 450; HCDR1 has the amino acid sequence shown in SEQ ID NO: 451; HCDR2 has the amino acid sequence shown in SEQ ID NO: 452; and HCDR3 has an amino acid sequence selected from the group consisting of SEQ ID NOs: 453-461. In certain embodiments, LCDR1 has the amino acid sequence shown in SEQ ID NO: 462; LCDR2 has the amino acid sequence shown in SEQ ID NO: 464; LCDR3 has the amino acid sequence shown in SEQ ID NO: 466; HCDR1 has the amino acid sequence shown in SEQ ID NO: 468; HCDR2 has the amino acid sequence shown in SEQ ID NO: 470; and HCDR3 has an amino acid sequence selected from the group consisting of SEQ ID NOs: 453-459. In some such embodiments, (a) LCDR1 and LCDR2 have the amino acid sequences shown, respectively, in residues 24-34 and residues 50-56 of SEQ ID NO: 170; (b) LCDR1 and LCDR2 have the amino acid sequences shown, respectively, in residues 24-34 and residues 50-56 of SEQ ID NO: 242; (c) LCDR1 and LCDR2 have the amino acid sequences shown, respectively, in residues 24-34 and residues 50-56 of SEQ ID NO: 278; (d) LCDR1 and LCDR2 have the amino acid sequences shown, respectively, in residues 24-34 and residues 50-56 of SEQ ID NO: 306; (e) LCDR1 and LCDR2 have the amino acid sequences shown, respectively, in residues 24-34 and residues 50-56 of SEQ ID NO: 322; (f) LCDR1 and LCDR2 have the amino acid sequences shown, respectively, in residues 24-34 and residues 50-56 of SEQ ID NO: 330; (g) LCDR1 and LCDR2 have the amino acid sequences shown, respectively, in residues 24-34 and residues 50-56 of SEQ ID NO: 374; (h) LCDR1 and LCDR2 have the amino acid sequences shown, respectively, in residues 24-34 and residues 50-56 of SEQ ID NO: 394; or (i) LCDR1 and LCDR2 have the amino acid sequences shown, respectively, in residues 24-34 and residues 50-56 of SEQ ID NO: 426. In particular variations of an anti-VEGF-A antibody as above, HCDR1 has the amino acid sequence shown in residues 31-35 of SEQ ID NO: 172, 244, 280, 308, or 324. In other variations of an anti-VEGF-A antibody as above, HCDR1 has the amino acid sequence shown in residues 31-35 of SEQ ID NO: 280 and HCDR2 has the amino acid sequence shown in residues 50-66 of SEQ ID NO: 280, 376, or 428.

In some embodiments, a neutralizing anti-VEGF-A antibody comprises a $V_L$ domain comprising CDRs LCDR1, LCDR2, and LCDR3 and a $V_H$ domain comprising CDRs HCDR1, HCDR2, and HCDR3, where LCDR1 has the amino acid sequence shown in SEQ ID NO: 463; LCDR2 has the amino acid sequence shown in SEQ ID NO: 465; LCDR3 has the amino acid sequence shown in SEQ ID NO: 467; HCDR1 has the amino acid sequence shown in residues 31-35 of SEQ ID NO: 280; HCDR2 has the amino acid sequence shown in residues 50-66 of SEQ ID NO: 280; and HCDR3 has an amino acid sequence selected from the group consisting of SEQ ID NOs: 453-459. In some embodiments, HCDR3 has an amino acid sequence selected from the group consisting of SEQ ID NOs: 453, 458, and 459.

In other embodiments, a neutralizing anti-VEGF-A antibody comprises a $V_L$ domain comprising CDRs LCDR1, LCDR2, and LCDR3 and a $V_H$ domain comprising CDRs HCDR1, HCDR2, and HCDR3, where LCDR1 has the amino acid sequence shown in residues 24-34 of SEQ ID NO: 170, 330, 394, or 426; LCDR2 has the amino acid sequence shown in residues 50-56 of SEQ ID NO: 170, 242, 322, 330, 394, or 426; LCDR3 has the amino acid sequence shown in residues 89-97 of SEQ ID NO: 170, 242, 278, 394, or 426; HCDR1 has the amino acid sequence shown in residues 31-35 of SEQ ID NO: 172, 244, 280, 308, or 324; HCDR2 has the amino acid sequence shown in residues 50-66 of SEQ ID NO: 172, 244, 280, or 324; and HCDR3 has an amino acid sequence selected from the group consisting of SEQ ID NOs: 453-459. In some such embodiments, (a) LCDR1, LCDR2, and LCDR3 have the amino acid sequences shown, respectively, in residues 24-34, residues 50-56, and residues 89-97 of SEQ ID NO: 170; and HCDR1, HCDR2, and HCDR3 have the amino acid sequences shown, respectively, in residues 31-35, residues 50-66, and residues 99-102 of SEQ ID NO: 172; (b) LCDR1, LCDR2, and LCDR3 have the amino acid sequences shown, respectively, in residues 24-34, residues 50-56, and residues 89-97 of SEQ ID NO: 242; and HCDR1, HCDR2, and HCDR3 have the amino acid sequences shown, respectively, in residues 31-35, residues 50-66, and residues 99-107 of SEQ ID NO: 244; (c) LCDR1, LCDR2, and LCDR3 have the amino acid sequences shown, respectively, in residues 24-34, residues 50-56, and residues 89-97 of SEQ ID NO: 278; and HCDR1, HCDR2, and HCDR3 have the amino acid sequences shown, respectively, in residues 31-35, residues 50-66, and residues 99-110 of SEQ ID NO: 280; (d) LCDR1, LCDR2, and LCDR3 have the amino acid sequences shown, respectively, in residues 24-34, residues 50-56, and residues 89-97 of SEQ ID NO: 306; and HCDR1, HCDR2, and HCDR3 have the amino acid sequences shown, respectively, in residues 31-35, residues 50-66, and residues 99-110 of SEQ ID NO: 308; (e) LCDR1, LCDR2, and LCDR3 have the amino acid sequences shown, respectively, in residues 24-34, residues 50-56, and residues 89-97 of SEQ ID NO: 322; and HCDR1, HCDR2, and HCDR3 have the amino acid sequences shown, respectively, in residues 31-35, residues 50-66, and residues 99-111 of SEQ ID NO: 324; (f) LCDR1, LCDR2, and LCDR3 have the amino acid sequences shown, respectively, in residues 24-34, residues 50-56, and residues 89-97 of SEQ ID NO: 330; and HCDR1, HCDR2, and HCDR3 have the amino acid sequences shown, respectively, in residues 31-35, residues 50-66, and residues 99-102 of SEQ ID NO: 332; (g) LCDR1, LCDR2, and LCDR3 have the amino acid sequences shown, respectively, in residues 24-34, residues 50-56, and residues 89-97 of SEQ ID NO: 374; and HCDR1, HCDR2, and HCDR3 have the amino acid sequences shown, respectively, in residues 31-35, residues 50-66, and residues 99-108 of SEQ ID NO: 376; (h) LCDR1, LCDR2, and LCDR3 have the amino acid sequences shown, respectively, in residues 24-34, residues 50-56, and residues 89-97 of SEQ ID NO: 394; and HCDR1, HCDR2, and HCDR3 have the amino acid sequences shown, respectively, in residues 31-35, residues 50-66, and residues 99-102 of SEQ ID NO: 396; or (i) LCDR1, LCDR2, and LCDR3 have the amino acid sequences shown, respectively, in residues 24-34, residues 50-56, and residues 89-97 of SEQ ID NO: 426; and HCDR1, HCDR2, and HCDR3 have the amino acid sequences shown, respectively, in residues 31-35, residues 50-66, and residues 99-107 of SEQ ID NO: 428. In specific variations, the $V_L$ and $V_H$ domains comprise the amino acid sequences as shown, respectively, in SEQ ID NOs: 170 and 172; SEQ ID NOs: 242 and 244; SEQ ID NOs: 278 and 280; SEQ ID NOs: 306 and 308; SEQ ID NOs: 322 and 324; SEQ ID NOs: 330 and 332; SEQ ID NOs: 374 and 376; SEQ ID NOs: 394 and 396; or SEQ ID NOs: 426 and 428.

In other embodiments, a neutralizing anti-VEGF-A antibody comprises a $V_L$ domain comprising CDRs LCDR1, LCDR2, and LCDR3 and a $V_H$ domain comprising CDRs HCDR1, HCDR2, and HCDR3, wherein said set of $V_L$ and $V_H$ CDRs has 3 or fewer amino acid substitutions relative to a second set of CDRs selected from the group consisting of: (a) LCDR1, LCDR2, and LCDR3 having the amino acid sequences shown, respectively, in residues 24-34, residues 50-56, and residues 89-97 of SEQ ID NO: 170; and HCDR1, HCDR2, and HCDR3 having the amino acid sequences shown, respectively, in residues 31-35, residues 50-66, and residues 99-102 of SEQ ID NO: 172; (b) LCDR1, LCDR2, and LCDR3 having the amino acid sequences shown, respectively, in residues 24-34, residues 50-56, and residues 89-97 of SEQ ID NO: 242; and HCDR1, HCDR2, and HCDR3 having the amino acid sequences shown, respectively, in residues 31-35, residues 50-66, and residues 99-107 of SEQ ID NO: 244; (c) LCDR1, LCDR2, and LCDR3 having the amino acid sequences shown, respectively, in residues 24-34, residues 50-56, and residues 89-97 of SEQ ID NO: 278; and HCDR1, HCDR2, and HCDR3 having the amino acid sequences shown, respectively, in residues 31-35, residues 50-66, and residues 99-110 of SEQ ID NO: 280; (d) LCDR1, LCDR2, and LCDR3 having the amino acid sequences shown, respectively, in residues 24-34, residues 50-56, and residues 89-97 of SEQ ID NO: 306; and HCDR1, HCDR2, and HCDR3 having the amino acid sequences shown, respectively, in residues 31-35, residues 50-66, and residues 99-110 of SEQ ID NO: 308; (e) LCDR1, LCDR2, and LCDR3 having the amino acid sequences shown, respectively, in residues 24-34, residues 50-56, and residues 89-97 of SEQ ID NO: 322; and HCDR1, HCDR2, and HCDR3 having the amino acid sequences shown, respectively, in residues 31-35, residues 50-66, and residues 99-111 of SEQ ID NO: 324; (f) LCDR1, LCDR2, and LCDR3 having the amino acid sequences shown, respectively, in residues 24-34, residues 50-56, and residues 89-97 of SEQ ID NO: 330; and HCDR1, HCDR2, and HCDR3 having the amino acid sequences shown, respectively, in residues 31-35, residues 50-66, and residues 99-102 of SEQ ID NO: 332; (g) LCDR1, LCDR2, and LCDR3 having the amino acid sequences shown, respectively, in residues 24-34, residues 50-56, and residues 89-97 of SEQ ID NO: 374; and HCDR1, HCDR2, and HCDR3 having the amino acid sequences shown, respectively, in residues 31-35, residues 50-66, and residues 99-108 of SEQ ID NO: 376; (h) LCDR1, LCDR2, and LCDR3 having the amino acid sequences shown, respectively, in residues 24-34, residues 50-56, and residues 89-97 of SEQ ID NO: 394; and HCDR1, HCDR2, and HCDR3 having the amino acid sequences shown, respectively, in residues 31-35, residues 50-66, and residues 99-102 of SEQ ID NO: 396; and (i) LCDR1, LCDR2, and LCDR3 having the amino acid sequences shown, respectively, in residues 24-34, residues 50-56, and residues 89-97 of SEQ ID NO: 426; and HCDR1, HCDR2, and HCDR3 having the amino acid sequences shown, respectively, in residues 31-35, residues 50-66, and residues 99-107 of SEQ ID NO: 428. In some embodiments, the antibody comprises zero, one, or two amino acid substitutions in said set of CDRs.

In yet other embodiments, a neutralizing anti-VEGF-A antibody comprises a $V_L$ domain comprising CDRs LCDR1, LCDR2, and LCDR3 and a $V_H$ domain comprising CDRs HCDR1, HCDR2, and HCDR3, where LCDR1 has the amino acid sequence shown in SEQ ID NO: 462; LCDR2 has the amino acid sequence shown in SEQ ID NO: 463; LCDR3 has an amino acid sequence selected from the group consisting of SEQ ID NOs: 464 and 465 HCDR1 has the amino acid sequence shown in SEQ ID NO: 466; HCDR2 has the amino acid sequence shown in SEQ ID NO: 467; and HCDR3 has an amino acid sequence selected from the group consisting of SEQ ID NOs: 468-470. In some such embodiments, LCDR1 has the amino acid sequence shown in SEQ ID NO: 471; LCDR2 has the amino acid sequence shown in SEQ ID NO: 474; HCDR1 has the amino acid sequence shown in SEQ ID NO: 477; HCDR2 has the amino acid sequence shown in SEQ ID NO: 478; and HCDR3 has an amino acid sequence selected from the group consisting of SEQ ID NOs: 468 and 469.

In certain variations, a neutralizing anti-VEGF-A antibody comprises a $V_L$ domain comprising CDRs LCDR1, LCDR2, and LCDR3 and a $V_H$ domain comprising CDRs HCDR1, HCDR2, and HCDR3, where LCDR1 has an amino acid sequence shown in SEQ ID NO: 472; LCDR2 has the amino acid sequence shown in SEQ ID NO: 475; LCDR3 has an amino acid sequence selected from the group consisting of SEQ ID NOs: 464 and 465; HCDR1 has the amino acid sequence shown in SEQ ID NO: 477; HCDR2 has the amino acid sequence shown in SEQ ID NO: 478; and HCDR3 has an amino acid sequence selected from the group consisting of SEQ ID NOs: 468 and 469. In some embodiments, HCDR1, HCDR2, and HCDR3 have the amino acid sequences shown, respectively, in residues 31-35, residues 50-66, and residues 99-102 of SEQ ID NO: 248. In some such embodiments, LCDR2 has the amino acid sequence shown in SEQ ID NO: 479 and LCDR3 has the amino acid sequence shown in SEQ ID NO: 480.

In other embodiments, a neutralizing anti-VEGF-A antibody comprises a $V_L$ domain comprising CDRs LCDR1, LCDR2, and LCDR3 and a $V_H$ domain comprising CDRs HCDR1, HCDR2, and HCDR3, where LCDR1 has the amino acid sequence shown in residues 23-35 of SEQ ID NO: 214, 246, 274, 286, 310, 338, or 354; LCDR2 has the amino acid sequence shown in residues 51-57 of SEQ ID NO: 214, 246, 274, 286, 310, 338, or 354; LCDR3 has an amino acid sequence shown in SEQ ID NO: 465 or in residues 90-100 of SEQ ID NO: 214, 246, 274, 286, 310, or 338; HCDR1 has an amino acid sequence shown in residues 31-35 of SEQ ID NO: 216, 248, or 356; HCDR2 has an amino acid sequence shown in residues 50-66 of SEQ ID NO: 216, 248, or 356; and HCDR3 has an amino acid sequence selected from the group consisting of SEQ ID NOs: 468-470. In certain variations, (a) LCDR1, LCDR2, and LCDR3 have the amino acid sequences shown, respectively, in residues 23-35, residues 51-57, and residues 90-100 of SEQ ID NO: 214; and HCDR1, HCDR2, and HCDR3 have the amino acid sequences shown, respectively, in residues 31-35, residues 50-66, and residues 99-110 of SEQ ID NO: 216; (b) LCDR1, LCDR2, and LCDR3 have the amino acid sequences shown, respectively, in residues 23-35, residues 51-57, and residues 90-100 of SEQ ID NO: 246; and HCDR1, HCDR2, and HCDR3 have the amino acid sequences shown, respectively, in residues 31-35, residues 50-66, and residues 99-102 of SEQ ID NO: 248; (c) LCDR1, LCDR2, and LCDR3 have the amino acid sequences shown, respectively, in residues 23-35, residues 51-57, and residues 90-100 of SEQ ID NO: 274; and HCDR1, HCDR2, and HCDR3 have the amino acid sequences shown, respectively, in residues 31-35, residues 50-66, and residues 99-102 of SEQ ID NO: 276; (d) LCDR1, LCDR2, and LCDR3 have the amino acid sequences shown, respectively, in residues 23-35, residues 51-57, and residues 90-100 of SEQ ID NO: 286; and HCDR1, HCDR2, and HCDR3 have the amino acid sequences shown, respectively, in residues 31-35, residues 50-66, and residues 99-102 of SEQ ID NO: 288; (e) LCDR1, LCDR2, and LCDR3 have the amino acid sequences shown, respectively, in residues 23-35, residues 51-57, and residues 90-100 of SEQ ID NO: 310; and HCDR1, HCDR2, and HCDR3 have the amino acid sequences shown, respectively, in residues 31-35, residues 50-66, and residues 99-102 of SEQ ID NO: 312; (f) LCDR1, LCDR2, and LCDR3 have the amino acid sequences shown, respectively, in residues 23-35, residues 51-57, and residues 90-100 of SEQ ID NO: 338; and HCDR1, HCDR2, and HCDR3 have the amino acid sequences shown, respectively, in residues 31-35, residues 50-66, and residues 99-102 of SEQ ID NO: 340; or (g) LCDR1, LCDR2, and LCDR3 have the amino acid sequences shown, respectively, in residues 23-35, residues 51-57, and residues 90-106 of SEQ ID NO: 354; and HCDR1, HCDR2, and HCDR3 have the amino acid sequences shown, respectively, in residues 31-35, residues 50-66, and residues 99-107 of SEQ ID NO: 356. In specific variations, the $V_L$ and $V_H$ domains comprise the amino acid sequences as shown, respectively, in SEQ ID NOs: 214 and 216; SEQ ID NOs: 246 and 248; SEQ ID NOs: 274 and 276; SEQ ID NOs: 286 and 288; SEQ ID NOs: 310 and 312; SEQ ID NOs: 338 and 340; or SEQ ID NOs: 354 and 356.

In still other embodiments, a neutralizing anti-VEGF-A antibody comprises a $V_L$ domain comprising CDRs LCDR1, LCDR2, and LCDR3 and a $V_H$ domain comprising CDRs HCDR1, HCDR2, and HCDR3, wherein said set of $V_L$ and $V_H$ CDRs has 3 or fewer amino acid substitutions relative to a second set of CDRs selected from the group consisting of: (a) LCDR1, LCDR2, and LCDR3 having the amino acid sequences shown, respectively, in residues 23-35, residues 51-57, and residues 90-100 of SEQ ID NO: 214; and HCDR1, HCDR2, and HCDR3 having the amino acid sequences shown, respectively, in residues 31-35, residues 50-66, and residues 99-110 of SEQ ID NO: 216; (b) LCDR1, LCDR2, and LCDR3 having the amino acid sequences shown, respectively, in residues 23-35, residues 51-57, and residues 90-100 of SEQ ID NO: 246; and HCDR1, HCDR2, and HCDR3 having the amino acid sequences shown, respectively, in residues 31-35, residues 50-66, and residues 99-102 of SEQ ID NO: 248; (c) LCDR1, LCDR2, and LCDR3 having the amino acid sequences shown, respectively, in residues 23-35, residues 51-57, and residues 90-100 of SEQ ID NO: 274; and HCDR1, HCDR2, and HCDR3 having the amino acid sequences shown, respectively, in residues 31-35, residues 50-66, and residues 99-102 of SEQ ID NO: 276; (d) LCDR1, LCDR2, and LCDR3 having the amino acid sequences shown, respectively, in residues 23-35, residues 51-57, and residues 90-100 of SEQ ID NO: 286; and HCDR1, HCDR2, and HCDR3 having the amino acid sequences shown, respectively, in residues 31-35, residues 50-66, and residues 99-102 of SEQ ID NO: 288; (e) LCDR1, LCDR2, and LCDR3 having the amino acid sequences shown, respectively, in residues 23-35, residues 51-57, and residues 90-100 of SEQ ID NO: 310; and HCDR1, HCDR2, and HCDR3 having the amino acid sequences shown, respectively, in residues 31-35, residues 50-66, and residues 99-102 of SEQ ID NO: 312; (f) LCDR1, LCDR2, and LCDR3 having the amino acid sequences shown, respectively, in residues 23-35, residues 51-57, and residues 90-100 of SEQ ID NO: 338; and HCDR1, HCDR2, and HCDR3 having the amino acid sequences shown, respectively, in residues 31-35, residues 50-66, and residues 99-102 of SEQ ID NO: 340; and (g) LCDR1, LCDR2, and LCDR3 having the amino acid sequences shown, respectively, in residues 23-35, residues 51-57, and residues 90-106 of SEQ ID NO: 354; and HCDR1, HCDR2, and HCDR3 having the amino acid sequences shown, respectively, in residues 31-35, residues 50-66, and residues 99-107 of SEQ ID NO: 356. In some embodiments, the antibody comprises zero, one, or two amino acid substitutions in said set of CDRs.

In certain embodiments, a neutralizing anti-VEGF-A antibody binds to an epitope comprising (a) one or more amino acids included within a first polypeptide region of VEGF-A as shown in amino acid residues 42-52 of SEQ ID NO: 2 and (b) one or more amino acids included within a second polypeptide region of VEGF-A as shown in amino acid residues 72-82 of SEQ ID NO: 2. Exemplary anti-VEGF-A antibodies having this epitope specificity include antibodies comprising light and heavy chain variable domains having respective $V_L$ and $V_H$ amino acid sequences selected from the following $V_L/V_H$ sequence pairs: SEQ ID NOs: 170 and 172; SEQ ID NOs: 242 and 244; SEQ ID NOs: 246 and 248; and SEQ ID NOs: 278 and 280.

In certain embodiments of an anti-VEGF-A antibody binding to an epitope comprising (a) and (b) as above, the epitope does not comprise an amino acid included within a polypeptide region of VEGF-A as shown in residues 90 to 132 of SEQ ID NO: 2 (EGLECVPTEESNITMQIMRIK-PHQGQHIGEMSFLQHNKCECRP). An exemplary anti-VEGF-A antibody of this class comprises light and heavy chain variable domains having the amino acid sequences as shown in SEQ ID NOs: 246 and 248, respectively.

In other embodiments of an anti-VEGF-A antibody binding to an epitope comprising (a) and (b) as above, the epitope further comprises (c) one or more amino acids included within a third polypeptide region of VEGF-A as shown in residues 98-114 of SEQ ID NO: 2. Exemplary anti-VEGF-A antibodies of this class include antibodies comprising light and heavy chain variable domains having respective $V_L$ and $V_H$ amino acid sequences selected from the following $V_L/V_H$ sequence pairs: SEQ ID NOs: 170 and 172; SEQ ID NOs: 242 and 244; and SEQ ID NOs: 278 and 280.

In some embodiments of an anti-VEGF-A antibody binding to an epitope comprising (a), (b), and (c) as above, the antibody does not bind to human and mouse VEGF-A with $K_d$ values within 10-fold of the other. Exemplary anti-VEGF-A antibodies of this class include antibodies comprising light and heavy chain variable domains having respective $V_L$ and $V_H$ amino acid sequences selected from the following $V_L/V_H$ sequence pairs: SEQ ID NOs: 242 and 244; and SEQ ID NOs: 278 and 280.

In certain embodiments, an anti-VEGF-A epitope as above is an epitope as determined by peptide microarray epitope mapping comprising the use of overlapping VEGF-A (SEQ ID NO: 2) 13-mer peptides.

In certain variations, a neutralizing anti-VEGF-A antibody as above is a bispecific antibody that also binds to the extracellular domain of PDGFRβ. In preferred variations, the bispecific antibody neutralizes PDGFRβ.

In some embodiments, a neutralizing anti-PDGFRβ or neutralizing anti-VEGF-A antibody as above is an antibody fragment comprising an antigen-binding region. Suitable antibody fragments include Fv, Fab, Fab', F(ab)₂, F(ab')₂, scFv, or diabody. In some preferred embodiments, an anti-PDGFRβ or anti-VEGF-A antibody is an scFv. In some embodiments, an anti-PDGFRβ or anti-VEGF-A antibody is PEGylated.

In another aspect, the present invention provides a bispecific binding composition that neutralizes both PDGFRβ and VEGF-A. Such bispecific binding compositions typically comprise (a) an isolated anti-PDGFRβ antibody as described above and (b) an isolated anti-VEGF-A antibody as described above. In some embodiments, the anti-PDGFRβ antibody and the anti-VEGF-A antibody are covalently linked via a linker. Particularly suitable linkers include polypeptide linkers. In some variations, the anti-PDGFRβ and anti-VEGF-A antibodies are single chain Fvs covalently linked to form a tandem single chain Fv (tascFv) or a bi-single chain Fv (biscFv). In some embodiments, the bispecific binding compositions further comprises a pharmaceutically acceptable carrier.

In a related aspect, the present invention provides a bispecific antibody that neutralizes both PDGFRβ and VEGF-A. In certain preferred embodiments, the bispecific antibody comprises (a) an antigen-binding region from an anti-PDGFRβ antibody as described above and (b) an antigen-binding region from an anti-VEGF-A antibody as described above. In certain embodiments, the bispecific antibody comprises an immunoglobulin heavy chain constant region such as, for example, an Fc fragment. Suitable Fc fragments include Fc regions modified to reduce or eliminate one or more effector functions. In some preferred variations, the bispecific antibody is a tascFv, a biscFv, or a biAb. In some embodiments, a bispecific antibody is PEGylated.

In some embodiments, a bispecific antibody that neutralizes both PDGFRβ and VEGF-A includes (I) a first antigen-binding region that specifically binds to the extracellular domain of PDGFRβ and neutralizes PDGFRβ activity, wherein the PDGFRβ-binding region binds to an epitope comprising one or more amino acids included within a polypeptide region of PDGFRβ as shown in residues 251-270 of SEQ ID NO: 4, and optionally comprising one or more amino acids included with a second polypeptide region of PDGFRβ as shown in residues 196-205 of SEQ ID NO: 4; and (II) a second antigen binding region that specifically binds to VEGF-A and neutralizes VEGF-A activity, wherein the VEGF-A-binding region binds to an epitope comprising (a) one or more amino acids included within a first polypeptide region of VEGF-A as shown in residues 42-52 of SEQ ID NO: 2 and (b) one or more amino acids included within a second polypeptide region of VEGF-A as shown in residues 72-82 of SEQ ID NO: 2. In some such embodiments, the anti-VEGF-A epitope (i) does not comprise an amino acid included within a polypeptide region of VEGF-A as shown in residues 90 to 132 of SEQ ID NO: 2; or (ii) further comprises one or more amino acids included within a third polypeptide region of VEGF-A as shown in residues 98-114 of SEQ ID NO: 2.

In particular variations of a bispecific antibody as above, (I) the PDGFRβ-binding region includes a $V_L$ domain ($V_{L-PDGFR}$) comprising CDRs LCDR1$_{PDGFR}$, LCDR2$_{PDGFR}$, and LCDR3$_{PDGFR}$ and a $V_H$ domain ($V_{H-PDGFR}$) comprising CDRs HCDR1$_{PDGFR}$, HCDR2$_{PDGFR}$, and HCDR3$_{PDGFR}$, wherein LCDR1$_{PDGFR}$ has the amino acid sequence shown in SEQ ID NO: 433; LCDR2$_{PDGFR}$ has the amino acid sequence shown in SEQ ID NO: 434; LCDR3$_{PDGFR}$ has the amino acid sequence shown in SEQ ID NO: 435; HCDR1$_{PDGFR}$ has the amino acid sequence shown in SEQ ID NO: 436; HCDR2$_{PDGFR}$ has the amino acid sequence shown in SEQ ID NO: 437; HCDR3$_{PDGFR}$ has an amino acid sequence selected from the group consisting of SEQ ID NOs: 438-442; and (II) the VEGF-A-binding region includes a $V_L$ domain ($V_{L-VEGF}$) comprising CDRs LCDR1$_{VEGF}$, LCDR2$_{VEGF}$, and LCDR3$_{VEGF}$ and a $V_H$ domain ($V_{H-VEGF}$) comprising CDRs HCDR1$_{VEGF}$, HCDR2$_{VEGF}$, and HCDR3$_{VEGF}$, wherein (A) LCDR1$_{VEGF}$ has the amino acid sequence shown in SEQ ID NO: 448; LCDR2$_{VEGF}$ has the amino acid sequence shown in SEQ. ID NO: 449; LCDR3$_{VEGF}$ has the amino acid sequence shown in SEQ ID NO: 450; HCDR1$_{VEGF}$ has the amino acid sequence shown in SEQ ID NO: 451; HCDR2$_{VEGF}$ has the amino acid sequence shown in SEQ ID NO: 452; HCDR3$_{VEGF}$ has an amino acid sequence selected from the group consisting of SEQ ID NOs: 453-461; or (B) LCDR1$_{VEGF}$ has the amino acid sequence shown in SEQ ID NO: 462; LCDR2$_{VEGF}$ has the amino acid sequence shown in SEQ ID NO: 463; LCDR3$_{VEGF}$ has an amino acid sequence selected from the group consisting of SEQ ID NOs: 464 and 465; HCDR1$_{VEGF}$ has the amino acid sequence shown in SEQ ID NO: 466; HCDR2$_{VEGF}$ has the amino acid sequence shown in SEQ ID NO: 467; HCDR3$_{VEGF}$ has an amino acid sequence selected from the group consisting of SEQ ID NOs: 468-470. In certain embodiments, LCDR1$_{PDGFR}$, LCDR2$_{PDGFR}$, and LCDR3$_{PDGFR}$ have the amino acid sequences shown, respectively, in residues 24-40, residues 56-62, and residues 95-103 of SEQ ID NO: 46; and HCDR1$_{PDGFR}$, HCDR2$_{PDGFR}$, and HCDR3$_{PDGFR}$ have the amino acid sequences shown, respectively, in residues 31-35, residues 50-66, and residues 99-111 of SEQ ID NO: 48. In some alternative embodiments, LCDR1$_{PDGFR}$, LCDR2$_{PDGFR}$, and LCDR3$_{PDGFR}$ have the amino acid sequences shown, respectively, in residues 24-40, residues 56-62, and residues 95-103 of SEQ ID NO: 6; and HCDR1$_{PDGFR}$, HCDR2$_{PDGFR}$, and HCDR3$_{PDGFR}$ have the amino acid sequences shown, respectively, in (a) residues 31-35, residues 50-66, and residues 99-110 of SEQ ID NO: 8, or (b) residues 31-35, residues 50-66, and residues 99-110 of SEQ ID NO: 12. In more specific variations, $V_{L-PDGFR}$ and $V_{H-PDGFR}$ comprise the amino acid sequences as shown in SEQ ID NOs: 46 and 48, respectively; or, alternatively, $V_{L\text{-}PDGFR}$ comprises the amino acid sequence as shown in SEQ ID NO: 6, and $V_{H\text{-}PDGFR}$ comprises the amino acid sequence as shown in SEQ ID NO: 8 or SEQ ID NO: 12.

In some embodiments of a bispecific antibody as above, the VEGF-A-binding region comprises the CDRs set forth in (II)(A). In particular variations, (a) $LCDR1_{VEGF}$, $LCDR2_{VEGF}$, and $LCDR3_{VEGF}$ have the amino acid sequences shown, respectively, in residues 24-34, residues 50-56, and residues 89-97 of SEQ ID NO: 242; and $HCDR1_{VEGF}$, $HCDR2_{VEGF}$, and $HCDR3_{VEGF}$ have the amino acid sequences shown, respectively, in residues 31-35, residues 50-66, and residues 99-107 of SEQ ID NO: 244; or (b) $LCDR1_{VEGF}$, $LCDR2_{VEGF}$, and $LCDR3_{VEGF}$ have the amino acid sequences shown, respectively, in residues 24-34, residues 50-56, and residues 89-97 of SEQ ID NO: 278; and $HCDR1_{VEGF}$, $HCDR2_{VEGF}$, and $HCDR3_{VEGF}$ have the amino acid sequences shown, respectively, in residues 31-35, residues 50-66, and residues 99-110 of SEQ ID NO: 280. In more specific variations, $V_{L\text{-}VEGF}$ and $V_{H\text{-}VEGF}$ comprise (a) the amino acid sequences as shown in SEQ ID NOs: 242 and 244, respectively, or (b) the amino acid sequences as shown in SEQ ID NOs: 278 and 280, respectively.

In other embodiments of a bispecific antibody as above, the VEGF-A-binding region comprises the CDRs set forth in (II)(B). In particular variations, $LCDR1_{VEGF}$, $LCDR2_{VEGF}$, and $LCDR3_{VEGF}$ have the amino acid sequences shown, respectively, in residues 23-35, residues 51-57, and residues 90-100 of SEQ ID NO: 246; and $HCDR1_{VEGF}$, $HCDR2_{VEGF}$, and $HCDR3_{VEGF}$ have the amino acid sequences shown, respectively, in residues 31-35, residues 50-66, and residues 99-102 of SEQ ID NO: 248. In more specific variations, $V_{L\text{-}VEGF}$ comprises the amino acid sequence as shown in SEQ ID NO: 246 and $V_{H\text{-}VEGF}$ comprises the amino acid sequence as shown in SEQ ID NO: 248.

Suitable bispecific antibodies as above include those in a bi-single chain Fv (biscFv) or biAb format. In some preferred embodiments in which the bispecific antibody is a biscFv, the biscFv comprises an amino acid sequence selected from the group consisting of (i) amino acid residues 20-770 of SEQ ID NO: 624, and (ii) amino acid residues 20-773 of SEQ ID NO: 628, and (iii) amino acid residues 20-768 of SEQ ID NO: 626. In other preferred embodiments in which the bispecific antibody is a biAb, the biAb includes an immunoglobulin light chain comprising $V_{L\text{-}PDGFR}$ as its $V_L$ domain and an immunoglobulin heavy chain comprising $V_{H\text{-}PDGFR}$ as its $V_H$ domain, wherein the heavy chain is fused at its C-terminus with a single chain Fv (scFv) comprising $V_{L\text{-}VEGF}$ and $V_{H\text{-}VEGF}$ so as to form an IgG-scFv fusion. In specific variations of such a biAb, the immunoglobulin light chain comprises the amino acid sequence as shown in residues 20-239 of SEQ ID NO: 537; and the IgG-scFv fusion comprises an amino acid sequence selected from the group consisting of (i) amino acid residues 20-729 of SEQ ID NO: 630, (ii) amino acid residues 20-732 of SEQ ID NO: 634, (iii) amino acid residues 20-729 of SEQ ID NO: 636, (iv) amino acid residues 20-732 of SEQ ID NO: 640, (v) amino acid residues 20-727 of SEQ ID NO: 632, and (vi) amino acid residues 20-727 of SEQ ID NO: 638.

In yet another aspect, the present invention provides a pharmaceutical composition comprising an antibody as described herein and a pharmaceutically acceptable carrier. In certain embodiments, a pharmaceutical composition comprises a neutralizing anti-PDGFRβ antibody. In other embodiments, a pharmaceutical composition comprises an neutralizing anti-VEGF-A antibody. In certain preferred variations, a pharmaceutical composition comprises both a neutralizing PDGFRβ antibody and a neutralizing VEGF-A antibody. Particularly preferred pharmaceutical compositions in accordance with the present invention comprise a bispecific antibody that binds and neutralizes both PDGFRβ and VEGF-A.

In another aspect, the present invention provides a polynucleotide encoding $V_L$ and/or $V_H$ domain of an antibody as described above. In some embodiments, a polynucleotide encodes a bispecific antibody that binds and neutralizes both PDGFRβ and VEGF-A. The present invention further provides an expression vector comprising a polynucleotide as above, as well as a host cell comprising such an expression vector and which may be used in methods for producing an antibody of the present invention. Such a method for producing an antibody of the invention typically comprises culturing the host cell under conditions in which the antibody is expressed and isolating the antibody from the host cell.

In still another aspect, the present invention provides a method of inhibiting angiogenesis in a subject via administration at least one of a PDGFRβ antagonist and a VEGF-A antagonist. In certain embodiments, the method includes administering to a subject having angiogenesis an effective amount of an anti-PDGFRβ antibody as described above, and optionally further comprises administering to the subject an effective amount of a VEGF-A antagonist. In other embodiments, the method includes administering to a subject having angiogenesis an effective amount of an anti-VEGF-A antibody as described above, and optionally further comprises administering to the subject an effective amount of a PDGFRβ antagonist. In certain preferred embodiments, the method includes administering to a subject having angiogenesis an effective amount of an anti-PDGFRβ antibody and an effective amount of an anti-VEGF-A antibody. Where the method includes administration of both a PDGFR antagonist and a VEGF-A antagonist, the PDGFRβ antagonist and the VEGF-A antagonist may be administered, for example, separately or simultaneously. In some variations, administration of the PDGFR antagonist and the VEGF-A antagonist comprises administering a bispecific binding composition comprising both a neutralizing anti-PDGFRβ antibody and a neutralizing anti-VEGF-A antibody. In other variations, administration of the PDGFRβ antagonist and the VEGF-A antagonist comprises administering a bispecific antibody that binds and neutralizes both PDGFRβ and VEGF-A.

In a related aspect, the present invention provides a method of treating a neovascular disorder in a subject via administration at least one of a PDGFRβ antagonist and a VEGF-A antagonist. In certain embodiments, the method includes administering to a subject having a neovascular disorder an effective amount of an anti-PDGFRβ antibody as described above, and optionally further comprises administering to the subject an effective amount of a VEGF-A antagonist. In other embodiments, the method includes administering to a subject having a neovascular disorder an effective amount of an anti-VEGF-A antibody as described above, and optionally further comprises administering to the subject an effective amount of a PDGFRβ antagonist. In certain preferred embodiments, the method includes administering to a subject having a neovascular disorder an effective amount of an anti-PDGFRβ antibody and an effective amount of an anti-VEGF-A antibody. Where the method includes administration of both a PDGFR antagonist and a VEGF-A antagonist, the PDGFRβ antagonist and the VEGF-A antagonist may be administered, for example, separately or simultaneously. In some variations, administration of the PDGFRβ antagonist and the VEGF-A antagonist comprises administering a bispecific binding composition comprising both a neutralizing anti-PDGFRβ antibody and a neutralizing anti-VEGF-A antibody. In other variations, administration of the PDGFRβ antagonist and the VEGF-A antagonist comprises administering a bispecific antibody that binds and neutralizes both PDGFRβ and VEGF-A.

In some embodiments of the method for treating a neovascular disorder, the neovascular disorder is a cancer characterized by solid tumor growth. In some specific variations, the cancer is a pancreatic cancer, renal cell carcinoma (RCC), colorectal cancer, non-small cell lung cancer (NSCLC), gastrointestinal stromal tumor (GIST), or glioblastoma.

In other embodiments of the method for treating a neovascular disorder, the neovascular disorder is a neovascular ocular disorder. In specific variations, the neovascular ocular disorder is age-related macular degeneration, diabetic retinopathy, iris neovascularization, neovascular glaucoma, or proliferative vitroretinopathy.

These and other aspects of the invention will become evident upon reference to the following detailed description of the invention and the attached drawings.

DEFINITIONS

Unless defined otherwise, all technical and scientific terms used herein have the same meaning as commonly understood by one of ordinary skill in the art pertinent to the methods and compositions described. As used herein, the following terms and phrases have the meanings ascribed to them unless specified otherwise.

A "polypeptide" is a polymer of amino acid residues joined by peptide bonds, whether produced naturally or synthetically. Polypeptides of less than about 10 amino acid residues are commonly referred to as "peptides."

A "protein" is a macromolecule comprising one or more polypeptide chains. A protein may also comprise non-peptidic components, such as carbohydrate groups. Carbohydrates and other non-peptidic substituents may be added to a protein by the cell in which the protein is produced, and will vary with the type of cell. Proteins are defined herein in terms of their amino acid backbone structures; substituents such as carbohydrate groups are generally not specified, but may be present nonetheless.

The terms "amino-terminal" and "carboxyl-terminal" are used herein to denote positions within polypeptides. Where the context allows, these terms are used with reference to a particular sequence or portion of a polypeptide to denote proximity or relative position. For example, a certain sequence positioned carboxyl-terminal to a reference sequence within a polypeptide is located proximal to the carboxyl terminus of the reference sequence, but is not necessarily at the carboxyl terminus of the complete polypeptide.

As used herein, "nucleic acid" or "nucleic acid molecule" refers to polynucleotides, such as deoxyribonucleic acid (DNA) or ribonucleic acid (RNA), oligonucleotides, fragments generated by the polymerase chain reaction (PCR), and fragments generated by any of ligation, scission, endonuclease action, and exonuclease action. Nucleic acid molecules can be composed of monomers that are naturally-occurring nucleotides (such as DNA and RNA), or analogs of naturally-occurring nucleotides (e.g., α-enantiomeric forms of naturally-occurring nucleotides), or a combination of both. Modified nucleotides can have alterations in sugar moieties and/or in pyrimidine or purine base moieties. Sugar modifications include, for example, replacement of one or more hydroxyl groups with halogens, alkyl groups, amines, and azido groups, or sugars can be functionalized as ethers or esters. Moreover, the entire sugar moiety can be replaced with sterically and electronically similar structures, such as aza-sugars and carbocyclic sugar analogs. Examples of modifications in a base moiety include alkylated purines and pyrimidines, acylated purines or pyrimidines, or other well-known heterocyclic substitutes. Nucleic acid monomers can be linked by phosphodiester bonds or analogs of such linkages. Analogs of phosphodiester linkages include phosphorothioate, phosphorodithioate, phosphoroselenoate, phosphorodiselenoate, phosphoroanilothioate, phosphoranilidate, phosphoramidate, and the like. The term "nucleic acid molecule" also includes so-called "peptide nucleic acids," which comprise naturally-occurring or modified nucleic acid bases attached to a polyamide backbone. Nucleic acids can be either single stranded or double stranded.

As used herein, the term "antagonist" denotes a compound that reduces the activity of another compound in a biological setting. Thus, a VEGF-A antagonist is a compound that reduces the biological activity of VEGF-A, and a PDGFRβ antagonist is compound that reduces the biological activity of PDGFRβ. Since the activities of both VEGF-A and PDGFRβ are dependent on the interactions of multiple molecules (including ligand, receptor, and signal transducers), antagonists can reduce the activity by acting directly on VEGF-A or PDGFRβ, or by acting on another molecule in the cognate biological pathway. For example, a PDGFRβ antagonist can reduce PDGFRβ activity by, e.g., binding to the receptor itself, by binding to one of its ligands, by interfering with receptor dimerization, or by interfering with receptor phosphorylation. Antagonists include, without limitation, antibodies, soluble receptors, and non-proteinaceous compounds that bind to a ligand or its receptor, or otherwise interfering with ligand-receptor interactions and/or other receptor functions.

The term "antibody" is used herein to denote proteins produced by the body in response to the presence of an antigen and that bind to the antigen, as well as antigen-binding fragments and engineered variants thereof. Hence, the terms "antibody" and "antibodies" include polyclonal antibodies, affinity-purified polyclonal antibodies, monoclonal antibodies, and antigen-binding antibody fragments, such as F(ab')$_2$ and Fab fragments. Genetically engineered intact antibodies and fragments, such as chimeric antibodies, humanized antibodies, single-chain Fv fragments, single-chain antibodies, diabodies, minibodies, linear antibodies, multivalent or multispecific hybrid antibodies, and the like are also included. Thus, the term "antibody" is used expansively to include any protein that comprises an antigen binding site of an antibody and is capable of binding to its antigen.

The term "genetically engineered antibodies" means antibodies wherein the amino acid sequence has been varied from that of a native antibody. Because of the relevance of recombinant DNA techniques in the generation of antibodies, one need not be confined to the sequences of amino acids found in natural antibodies; antibodies can be redesigned to obtain desired characteristics. The possible variations are many and range from the changing of just one or a few amino acids to the complete redesign of, for example, the variable or constant region. Changes in the constant region will, in general, be made in order to improve or alter characteristics, such as complement fixation, interaction with cells and other effector functions. Typically, changes in the variable region will be made in order to improve the antigen binding characteristics, improve variable region stability, or reduce the risk of immunogenicity.

An "antigen-binding site of an antibody" is that portion of an antibody that is sufficient to bind to its antigen. The minimum such region is typically a variable domain or a genetically engineered variant thereof. Single-domain binding sites can be generated from camelid antibodies (see Muyldermans and Lauwereys, *J. Mol. Recog.* 12:131-140, 1999; Nguyen et al., *EMBO J.* 19:921-930, 2000) or from $V_H$ domains of other species to produce single-domain antibodies ("dAbs"; see Ward et al., *Nature* 341:544-546, 1989; U.S. Pat. No. 6,248,516 to Winter et al.). In certain variations, an antigen-binding site is a polypeptide region having only 2 complementarity determining regions (CDRs) of a naturally or non-naturally (e.g., mutagenized) occurring heavy chain variable domain or light chain variable domain, or combination thereof (see, e.g., Pessi et al., *Nature* 362: 367-369, 1993; Qiu et al., *Nature Biotechnol.* 25:921-929, 2007). More commonly, an antigen-binding site of an antibody comprises both a heavy chain variable domain and a light chain variable domain that bind to a common epitope. Within the present invention, a molecule that "comprises an antigen-binding site of an antibody" may further comprise one or more of a second antigen-binding site of an antibody (which may bind to the same or a different epitope or to the same or a different antigen), a peptide linker, an immunoglobulin constant domain, an immunoglobulin hinge, an amphipathic helix (see Pack and Pluckthun, *Biochem.* 31:1579-1584, 1992), a non-peptide linker, an oligonucleotide (see Chaudri et al., *FEBS Letters* 450:23-26, 1999), and the like, and may be a monomeric or multimeric protein. Examples of molecules comprising an antigen-binding site of an antibody are known in the art and include, for example, Fv fragments, single-chain Fv fragments (scFv), Fab fragments, diabodies, minibodies, Fab-scFv fusions, bispecific (scFv)-4-IgG, and bispecific (scFv)$_2$-Fab. (See, e.g., Hu et al., *Cancer Res.* 56:3055-3061, 1996; Atwell et al., *Molecular Immunology* 33:1301-1312, 1996; Carter and Merchant, *Curr. Opin. Biotechnol.* 8:449-454, 1997; Zuo et al., *Protein Engineering* 13:361-367, 2000; and Lu et al., *J. Immunol. Methods* 267:213-226, 2002.)

As used herein, the term "immunoglobulin" refers to a protein consisting of one or more polypeptides substantially encoded by immunoglobulin gene(s). One form of immunoglobulin constitutes the basic structural unit of an antibody. This form is a tetramer and consists of two identical pairs of immunoglobulin chains, each pair having one light and one heavy chain. In each pair, the light and heavy chain variable regions are together responsible for binding to an antigen, and the constant regions are responsible for the antibody effector functions. Immunoglobulins typically function as antibodies in a vertebrate organism. Five classes of immunoglobulin protein (IgG, IgA, IgM, IgD, and IgE) have been identified in higher vertebrates. IgG comprises the major class; it normally exists as the second most abundant protein found in plasma. In humans, IgG consists of four subclasses, designated IgG1, IgG2, IgG3, and IgG4. The heavy chain constant regions of the IgG class are identified with the Greek symbol γ. For example, immunoglobulins of the IgG1 subclass contain a γ1 heavy chain constant region. Each immunoglobulin heavy chain possesses a constant region that consists of constant region protein domains ($C_H1$, hinge, $C_H2$, and $C_H3$; IgG3 also contains a $C_H4$ domain) that are essentially invariant for a given subclass in a species. DNA sequences encoding human and non-human immunoglobulin chains are known in the art. (See, e.g., Ellison et al., *DNA* 1:11-18, 1981; Ellison et al., *Nucleic Acids Res.* 10:4071-4079, 1982; Kenten et al., *Proc. Natl. Acad. Sci. USA* 79:6661-6665, 1982; Seno et al., *Nuc. Acids Res.* 11:719-726, 1983; Riechmann et al., *Nature* 332:323-327, 1988; Amster et al., *Nuc. Acids Res.* 8:2055-2065, 1980; Rusconi and Kohler, *Nature* 314:330-334, 1985; Boss et al., *Nuc. Acids Res.* 12:3791-3806, 1984; Bothwell et al., *Nature* 298:380-382, 1982; van der Loo et al., *Immunogenetics* 42:333-341, 1995; Karlin et al., *J. Mol. Evol.* 22:195-208, 1985; Kindsvogel et al., *DNA* 1:335-343, 1982; Breiner et al., *Gene* 18:165-174, 1982; Kondo et al., *Eur. J Immunol.* 23:245-249, 1993; and GenBank Accession No. J00228.) For a review of immunoglobulin structure and function see Putnam, *The Plasma Proteins*, Vol V, Academic Press, Inc., 49-140, 1987; and Padlan, *Mol. Immunol.* 31:169-217, 1994. The term "immunoglobulin" is used herein for its common meaning, denoting an intact antibody, its component chains, or fragments of chains, depending on the context.

Full-length immunoglobulin "light chains" (about 25 Kd or 214 amino acids) are encoded by a variable region gene at the $NH_2$-terminus (encoding about 110 amino acids) and a by a kappa or lambda constant region gene at the COOH-terminus. Full-length immunoglobulin "heavy chains" (about 50 Kd or 446 amino acids) are encoded by a variable region gene (encoding about 116 amino acids) and a gamma, mu, alpha, delta, or epsilon constant region gene (encoding about 330 amino acids), the latter defining the antibody's isotype as IgG, IgM, IgA, IgD, or IgE, respectively. Within light and heavy chains, the variable and constant regions are joined by a "J" region of about 12 or more amino acids, with the heavy chain also including a "D" region of about 10 more amino acids. (See generally Fundamental Immunology (Paul, ed., Raven Press, N.Y., 2nd ed. 1989), Ch. 7).

An immunoglobulin "Fv" fragment contains a heavy chain variable domain ($V_H$) and a light chain variable domain ($V_L$), which are held together by non-covalent interactions. An immunoglobulin Fv fragment thus contains a single antigen-binding site. The dimeric structure of an Fv fragment can be further stabilized by the introduction of a disulfide bond via mutagenesis. (See Almog et al., *Proteins* 31:128-138, 1998.)

As used herein, the terms "single-chain Fv" and "single-chain antibody" refer to antibody fragments that comprise, within a single polypeptide chain, the variable regions from both heavy and light chains, but lack constant regions. In general, a single-chain antibody further comprises a polypeptide linker between the $V_H$ and $V_L$ domains, which enables it to form the desired structure that allows for antigen binding. Single-chain antibodies are discussed in detail by, for example, Pluckthun in *The Pharmacology of Monoclonal Antibodies*, vol. 113 (Rosenburg and Moore eds., Springer-Verlag, New York, 1994), pp. 269-315. (See also WIPO Publication WO 88/01649; U.S. Pat. Nos. 4,946, 778 and 5,260,203; Bird et al., *Science* 242:423-426, 1988.) Single-chain antibodies can also be bi-specific and/or humanized.

A "Fab fragment" contains one light chain and the $C_H1$ and variable regions of one heavy chain. The heavy chain of a Fab fragment cannot form a disulfide bond with another heavy chain molecule.

A "Fab' fragment" contains one light chain and one heavy chain that contains more of the constant region, between the $C_H1$ and $C_H2$ domains, such that an interchain disulfide bond can be formed between two heavy chains to form a $F(ab')_2$ molecule.

A "$F(ab')_2$ fragment" contains two light chains and two heavy chains containing a portion of the constant region between the $C_H1$ and $C_H2$ domains, such that an interchain disulfide bond is formed between two heavy chains.

An immunoglobulin "Fc fragment" (or Fc domain) is the portion of an antibody that is responsible for binding to antibody receptors on cells and the C1q component of complement. Fc stands for "fragment crystalline," the fragment of an antibody that will readily form a protein crystal. Distinct protein fragments, which were originally described by proteolytic digestion, can define the overall general structure of an immunoglobulin protein. As originally defined in the literature, the Fc fragment consists of the disulfide-linked heavy chain hinge regions, $C_H2$, and $C_H3$ domains. However, more recently the term has been applied to a single chain consisting of $C_H3$, $C_H2$, and at least a portion of the hinge sufficient to form a disulfide-linked dimer with a second such chain. For a review of immunoglobulin structure and function, see Putnam, *The Plasma Proteins*, Vol. V (Academic Press, Inc., 1987), pp. 49-140; and Padlan, *Mol. Immunol.* 31:169-217, 1994. As used herein, the term Fc includes variants of naturally occurring sequences.

An immunoglobulin light or heavy chain variable region consists of a "framework" region interrupted by three hypervariable regions. Thus, the term "hypervariable region" refers to the amino acid residues of an antibody that are responsible for antigen binding. The hypervariable region comprises amino acid residues from a "Complementarity Determining Region" or "CDR" (e.g., in human, residues 24-34 (L1), 50-56 (L2), and 89-97 (L3) in the light chain variable domain and residues 31-35 (H1), 50-65 (H2) and 95-102 (H3) in the heavy chain variable domain (amino acid sequence numbers based on the EU index; see Kabat et al., *Sequences of Proteins of Immunological Interest*, 5th Ed. Public Health Service, National Institutes of Health, Bethesda, Md. (1991)) and/or those residues from a "hypervariable loop" (in human, residues 26-32 (L1), 50-52 (L2) and 91-96 (L3) in the light chain variable domain and 26-32 (H1), 53-55 (H2) and 96-101 (H3) in the heavy chain variable domain; Chothia and Lesk, *J. Mol. Biol.* 196: 901-917, 1987) (both of which are incorporated herein by reference). "Framework Region" or "FR" residues are those variable domain residues other than the hypervariable region residues as herein defined. The sequences of the framework regions of different light or heavy chains are relatively conserved within a species. Thus, a "human framework region" is a framework region that is substantially identical (about 85% or more, usually 90-95% or more) to the framework region of a naturally occurring human immunoglobulin. The framework region of an antibody, that is the combined framework regions of the constituent light and heavy chains, serves to position and align the CDR's. The CDR's are primarily responsible for binding to an epitope of an antigen. CDRs L1, L2, and L3 of the $V_L$ domain are also referred to herein, respectively, as LCDR1, LCDR2, and LCDR3; CDRs H1, H2, and H3 of the $V_H$ domain are also referred to herein, respectively, as HCDR1, HCDR2, and HCDR3.

"Chimeric antibodies" are antibodies whose light and heavy chain genes have been constructed, typically by genetic engineering, from immunoglobulin variable and constant region genes belonging to different species. For example, the variable segments of the genes from a mouse monoclonal antibody may be joined to human constant region-encoding segments (e.g., human gamma 1 or gamma 3 heavy chain genes, and human kappa light chain genes). A therapeutic chimeric antibody is thus a hybrid protein, typically composed of the variable or antigen-binding domains from a mouse antibody and the constant domains from a human antibody, although other mammalian species may be used. Specifically, a chimeric antibody is produced by recombinant DNA technology in which all or part of the hinge and constant regions of an immunoglobulin light chain, heavy chain, or both, have been substituted for the corresponding regions from another animal's immunoglobulin light chain or heavy chain. In this way, the antigen-binding portion of the parent monoclonal antibody is grafted onto the backbone of another species' antibody. Chimeric antibodies may be optionally "cloaked" with a human-like surface by replacement of exposed residues, the result of which is a "veneered antibody."

As used herein, the term "human antibody" includes an antibody that has an amino acid sequence of a human immunoglobulin and includes antibodies isolated from human immunoglobulin libraries or from animals transgenic for one or more human immunoglobulin genes and that do not express endogenous immunoglobulins, as described, for example, in U.S. Pat. No. 5,939,598 to Kucherlapati et al.

The term "humanized immunoglobulin" refers to an immunoglobulin comprising a human framework region and one or more CDR's from a non-human (e.g., a mouse or rat) immunoglobulin. The non-human immunoglobulin providing the CDR's is called the "donor" and the human immunoglobulin providing the framework is called the "acceptor." Constant regions need not be present, but if they are, they must be substantially identical to human immunoglobulin constant regions, i.e., at least about 85-90%, preferably about 95% or more identical. Hence, all parts of a humanized immunoglobulin, except possibly the CDR's, are substantially identical to corresponding parts of natural human immunoglobulin sequences. In some instances, humanized antibodies may retain non-human residues within the human variable region framework domains to enhance proper binding characteristics (e.g., mutations in the frameworks may be required to preserve binding affinity when an antibody is humanized). A "humanized antibody" is an antibody comprising a humanized light chain and a humanized heavy chain immunoglobulin. For example, a humanized antibody would not encompass a typical chimeric antibody as defined above because, e.g., the entire variable region of a chimeric antibody is non-human.

A "bispecific" or "bifunctional" antibody is a hybrid antibody having two different heavy/light chain pairs and two different binding sites. Bispecific antibodies may be produced by a variety of methods including, but not limited to, fusion of hybridomas or linking of Fab' fragments. See, e.g., Songsivilai & Lachmann, *Clin. Exp. Immunol.* 79:315-321, 1990; Kostelny et al., *J. Immunol.* 148:1547-1553, 1992.

A "bivalent antibody" other than a "multispecific" or "multifunctional" antibody, in certain embodiments, is an antibody comprising two binding sites having identical antigenic specificity.

The term "diabodies" refers to small antibody fragments with two antigen-binding sites, which fragments comprise a heavy chain variable domain ($V_H$) connected to a light chain variable domain ($V_L$) in the same polypeptide chain ($V_H$-$V_L$). By using a linker that is too short to allow pairing between the two domains on the same chain, the domains are forced to pair with the complementary domains of another chain and create two antigen-binding sites. Diabodies are described more fully in, for example, EP 404,097; WO 93/11161; and Hollinger et al., *Proc. Natl. Acad. Sci. USA* 90:6444-6448, 1993.

The term "minibody" refers herein to a polypeptide that encodes only 2 complementarity determining regions (CDRs) of a naturally or non-naturally (e.g., mutagenized) occurring heavy chain variable domain or light chain variable domain, or combination thereof. Examples of minibodies are described by, e.g., Pessi et al., *Nature* 362:367-369, 1993; and Qiu et al., *Nature Biolechnol.* 25:921-929, 2007.

The term "linear antibodies" refers to the antibodies described in Zapata et al., *Protein Eng.* 8:1057-1062, 1995. Briefly, these antibodies comprise a pair of tandem Fd segments ($V_H$-$C_{H1}$-$V_H$-$C_{H1}$) which form a pair of antigen binding regions. Linear antibodies can be bispecific or monospecific.

The term "monoclonal antibody" as used herein is not limited to antibodies produced through hybridoma technology. The term "monoclonal antibody" refers to an antibody that is derived from a single clone, including any eukaryotic, prokaryotic, or phage clone, and not the method by which it is produced.

The term "parent antibody" as used herein refers to an antibody which is encoded by an amino acid sequence used for the preparation of the variant. Preferably, the parent antibody has a human framework region and, if present, has human antibody constant region(s). For example, the parent antibody may be a humanized or human antibody.

A "variant" anti-PDGFRβ or anti-VEGF-A antibody, refers herein to a molecule which differs in amino acid sequence from a "parent" anti-PDGFRβ or anti-VEGF-A antibody amino acid sequence by virtue of addition, deletion and/or substitution of one or more amino acid residue(s) in the parent antibody sequence. In the preferred embodiment, the variant comprises one or more amino acid substitution(s) in one or more hypervariable region(s) of the parent antibody. For example, the variant may comprise at least one, e.g., from about one to about ten, and preferably from about two to about five, substitutions in one or more hypervariable regions of the parent antibody. Ordinarily, the variant will have an amino acid sequence having at least 75% amino acid sequence identity with the parent antibody heavy or light chain variable domain sequences, more preferably at least 80%, more preferably at least 85%, more preferably at least 90%, and most preferably at least 95%. Identity or homology with respect to this sequence is defined herein as the percentage of amino acid residues in the candidate sequence that are identical with the parent antibody residues, after aligning the sequences and introducing gaps, if necessary, to achieve the maximum percent sequence identity. None of N-terminal, C-terminal, or internal extensions, deletions, or insertions into the antibody sequence shall be construed as affecting sequence identity or homology. The variant retains the ability to bind human PDGFRβ or VEGF-A and preferably has properties which are superior to those of the parent antibody. For example, the variant may have a stronger binding affinity, enhanced ability to inhibit PDGFRβ-induced or VEGF-A-induced biological activity (e.g., angiogenesis). To analyze such properties, one should compare a Fab form of the variant to a Fab form of the parent antibody or a full length form of the variant to a full length form of the parent antibody, for example, since it has been found that the format of an anti-PDGFRβ or anti-VEGF-A antibody impacts its activity in the biological activity assays disclosed herein. The variant antibody of particular interest herein is one which displays about at least a 3 fold, 5 fold, 10 fold, 20 fold, or 50 fold, enhancement in biological activity when compared to the parent antibody.

The term "epitope" includes any protein determinant capable of specific binding to an immunoglobulin or T-cell receptor. Epitopic determinants usually consist of chemically active surface groupings of molecules such as amino acids or sugar side chains and usually have specific three dimensional structural characteristics, as well as specific charge characteristics. More specifically, the term "PDGFRβ epitope" or "VEGF-A epitope" as used herein refers to a portion of the PDGFRβ or VEGF-A polypeptide having antigenic or immunogenic activity in an animal, preferably in a mammal, and most preferably in a mouse or a human. An epitope having immunogenic activity is a portion of a PDGFRβ or VEGF-A polypeptide that elicits an antibody response in an animal. An epitope having antigenic activity is a portion of a PDGFRβ or VEGF-A polypeptide to which an antibody immunospecifically binds as determined by any method well known in the art, for example, by immunoassays. Antigenic epitopes need not necessarily be immunogenic.

A "cloning vector" is a nucleic acid molecule, such as a plasmid, cosmid, or bacteriophage, that has the capability of replicating autonomously in a host cell. Cloning vectors typically contain one or a small number of restriction endonuclease recognition sites that allow insertion of a nucleic acid molecule in a determinable fashion without loss of an essential biological function of the vector, as well as nucleotide sequences encoding a marker gene that is suitable for use in the identification and selection of cells transformed with the cloning vector. Marker genes typically include genes that provide tetracycline resistance or ampicillin resistance.

The term "expression" refers to the biosynthesis of a product encoded by a nucleic acid. For example, in the case of nucleic acid segment encoding a polypeptide of interest, expression involves transcription of the nucleic acid segment into mRNA and the translation of mRNA into one or more polypeptides.

The terms "expression unit" and "expression cassette" are used interchangeably herein and denote a nucleic acid segment encoding a polypeptide of interest and capable of providing expression of the nucleic acid segment in a host cell. An expression unit typically comprises a transcription promoter, an open reading frame encoding the polypeptide of interest, and a transcription terminator, all in operable configuration. In addition to a transcriptional promoter and terminator, an expression unit may further include other nucleic acid segments such as, e.g., an enhancer or a polyadenylation signal.

The term "expression vector," as used herein, refers to a nucleic acid molecule, linear or circular, comprising one or more expression units. In addition to one or more expression units, an expression vector may also include additional nucleic acid segments such as, for example, one or more origins of replication or one or more selectable markers. Expression vectors are generally derived from plasmid or viral DNA, or may contain elements of both.

With regard to proteins as described herein, reference to amino acid residues corresponding to those specified by SEQ ID NO includes post-translational modifications of such residues.

The terms "neovascularization" and "angiogenesis" are used interchangeably herein. Neovascularization and angiogenesis refer to the generation of new blood vessels into cells, tissue, or organs. The control of angiogenesis is typically is typically altered in certain disease states and, in many case, the pathological damage associated with the disease is related to altered or unregulated angiogenesis. Persistent, unregulated angiogenesis occurs in a variety of disease states, including those characterized by the abnormal growth by endothelial cells, and supports the pathological damage seen in these conditions including leakage and permeability of blood vessels.

The term "neovascular disorder" are used herein refers to any disease or disorder having a pathology that is mediated, at least in part, by increased or unregulated angiogenesis activity. Examples of such diseases or disorders include various cancers comprising solid tumors (e.g., pancreatic cancer, renal cell carcinoma (RCC), colorectal cancer, non-small cell lung cancer (NSCLC), and gastrointestinal stromal tumor (GIST)) as well as certain ocular diseases involving neovascularization ("neovascular ocular disorders"). Such diseases or disorders are particularly amenable to certain treatment methods for inhibition angiogenesis, as described further herein.

"Neovascular ocular disorder," as used herein, refers to a neovascular disorder involving the eye of a patient (i.e., a disease or disorder having a pathology that is mediated, at least in part, by increased or unregulated angiogenesis activity in the eye of the patient). Examples of neovascular ocular disorders amenable to treatment in accordance with the present invention include age-related macular degeneration, diabetic retinopathy, iris neovascularization, neovascular glaucoma, proliferative vitroretinopathy, optic disc neovascularization, corneal neovascularization, vitreal neovascularization, pannus, pterygium, macular edema, diabetic macular edema, vascular retinopathy, retinal degeneration, uveitis, and inflammatory diseases of the retina.

The term "effective amount," in the context of treatment of a neovascular disorder by administration of a PDGFRβ and/or VEGF-A antagonist to a subject as described herein, refers to an amount of such agent that is sufficient to inhibit angiogenesis in the subject so as to inhibit the occurrence or ameliorate one or more symptoms of the neovascular disorder. An effective amount of an agent is administered according to the methods of the present invention in an "effective regime." The term "effective regime" refers to a combination of amount of the agent being administered and dosage frequency adequate to accomplish treatment or prevention of the disease or disorder.

The term "patient" or "subject," in the context of treating a disease or disorder as described herein, includes mammals such as, for example, humans and other primates. The term also includes domesticated animals such as, e.g., cows, hogs, sheep, horses, dogs, and cats.

Two amino acid sequences have "100% amino acid sequence identity" if the amino acid residues of the two amino acid sequences are the same when aligned for maximal correspondence. Similarly, two nucleotide sequences have "100% nucleotide sequence identity" if the nucleotide residues of the two nucleotide sequences are the same when aligned for maximal correspondence. Sequence comparisons can be performed using standard software programs such as those included in the LASERGENE bioinformatics computing suite, which is produced by DNASTAR (Madison, Wis.). Other methods for comparing two nucleotide or amino acid sequences by determining optimal alignment are well-known to those of skill in the art. (See, e.g., Peruski and Peruski, *The Internet and the New Biology: Tools for Genomic and Molecular Research* (ASM Press, Inc. 1997); Wu et al. (eds.), "Information Superhighway and Computer Databases of Nucleic Acids and Proteins," in *Methods in Gene Biotechnology* 123-151 (CRC Press, Inc. 1997); Bishop (ed.), *Guide to Human Genome Computing* (2nd ed., Academic Press, Inc. 1998).) Two nucleotide or amino acid sequences are considered to have "substantially similar sequence identity" or "substantial sequence identity" if the two sequences have at least 80%, at least 90%, or at least 95% sequence identity relative to each other.

Percent sequence identity is determined by conventional methods. See, e.g., Altschul et al., *Bull. Math. Bio.* 48:603, 1986, and Henikoff and Henikoff, *Proc. Natl. Acad. Sci. USA* 89:10915, 1992. For example, two amino acid sequences can be aligned to optimize the alignment scores using a gap opening penalty of 10, a gap extension penalty of 1, and the "BLOSUM62" scoring matrix of Henikoff and Henikoff, supra, as shown in Table 1 (amino acids are indicated by the standard one-letter codes). The percent identity is then calculated as: ([Total number of identical matches]/[length of the longer sequence plus the number of gaps introduced into the longer sequence in order to align the two sequences])(100).

TABLE 1

| BLOSUM62 Scoring Matrix | | | | | | | | | | | | | | | | | | | | |
|---|---|---|---|---|---|---|---|---|---|---|---|---|---|---|---|---|---|---|---|---|
|   | A | R | N | D | C | Q | E | G | H | I | L | K | M | F | P | S | T | W | Y | V |
| A | 4 |   |   |   |   |   |   |   |   |   |   |   |   |   |   |   |   |   |   |   |
| R | -1 | 5 |   |   |   |   |   |   |   |   |   |   |   |   |   |   |   |   |   |   |
| N | -2 | 0 | 6 |   |   |   |   |   |   |   |   |   |   |   |   |   |   |   |   |   |
| D | -2 | -2 | 1 | 6 |   |   |   |   |   |   |   |   |   |   |   |   |   |   |   |   |
| C | 0 | -3 | -3 | -3 | 9 |   |   |   |   |   |   |   |   |   |   |   |   |   |   |   |
| Q | -1 | 1 | 0 | 0 | -3 | 5 |   |   |   |   |   |   |   |   |   |   |   |   |   |   |
| E | -1 | 0 | 0 | 2 | -4 | 2 | 5 |   |   |   |   |   |   |   |   |   |   |   |   |   |
| G | 0 | -2 | 0 | -1 | -3 | -2 | -2 | 6 |   |   |   |   |   |   |   |   |   |   |   |   |
| H | -2 | 0 | 1 | -1 | -3 | 0 | 0 | -2 | 8 |   |   |   |   |   |   |   |   |   |   |   |
| I | -1 | -3 | -3 | -3 | -1 | -3 | -3 | -4 | -3 | 4 |   |   |   |   |   |   |   |   |   |   |
| L | -1 | -2 | -3 | -4 | -1 | -2 | -3 | -4 | -3 | 2 | 4 |   |   |   |   |   |   |   |   |   |
| K | -1 | 2 | 0 | -1 | -3 | 1 | 1 | -2 | -1 | -3 | -2 | 5 |   |   |   |   |   |   |   |   |
| M | -1 | -1 | -2 | -3 | -1 | 0 | -2 | -3 | -2 | 1 | 2 | -1 | 5 |   |   |   |   |   |   |   |
| F | -2 | -3 | -3 | -3 | -2 | -3 | -3 | -3 | -1 | 0 | 0 | -3 | 0 | 6 |   |   |   |   |   |   |
| P | -1 | -2 | -2 | -1 | -3 | -1 | -1 | -2 | -2 | -3 | -3 | -1 | -2 | -4 | 7 |   |   |   |   |   |
| S | 1 | -1 | 1 | 0 | -1 | 0 | 0 | 0 | -1 | -2 | -2 | 0 | -1 | -2 | -1 | 4 |   |   |   |   |
| T | 0 | -1 | 0 | -1 | -1 | -1 | -1 | -2 | -2 | -1 | -1 | -1 | -1 | -2 | -1 | 1 | 5 |   |   |   |
| W | -3 | -3 | -4 | -4 | -2 | -2 | -3 | -2 | -2 | -3 | -2 | -3 | -1 | 1 | -4 | -3 | -2 | 11 |   |   |
| Y | -2 | -2 | -2 | -3 | -2 | -1 | -2 | -3 | 2 | -1 | -1 | -2 | -1 | 3 | -3 | -2 | -2 | 2 | 7 |   |
| V | 0 | -3 | -3 | -3 | -1 | -2 | -2 | -3 | -3 | 3 | 1 | -2 | 1 | -1 | -2 | -2 | 0 | -3 | -1 | 4 |

Those skilled in the art appreciate that there are many established algorithms available to align two amino acid sequences. The "FASTA" similarity search algorithm of Pearson and Lipman is a suitable protein alignment method for examining the level of identity shared by an amino acid sequence disclosed herein and a second amino acid sequence. The FASTA algorithm is described by Pearson and Lipman, *Proc. Nat'l Acad. Sci. USA* 85:2444, 1988, and by Pearson, *Meth. Enzymol.* 183:63, 1990. Briefly, FASTA first characterizes sequence similarity by identifying regions shared by the query sequence (e.g., residues 25-266 of SEQ ID NO: 2) and a test sequence that have either the highest density of identities (if the ktup variable is 1) or pairs of identities (if ktup=2), without considering conservative amino acid substitutions, insertions, or deletions. The ten regions with the highest density of identities are then rescored by comparing the similarity of all paired amino acids using an amino acid substitution matrix, and the ends of the regions are "trimmed" to include only those residues that contribute to the highest score. If there are several regions with scores greater than the "cutoff" value (calculated by a predetermined formula based upon the length of the sequence and the ktup value), then the trimmed initial regions are examined to determine whether the regions can be joined to form an approximate alignment with gaps. Finally, the highest scoring regions of the two amino acid sequences are aligned using a modification of the Needleman-Wunsch-Sellers algorithm (Needleman and Wunsch, *J. Mol. Biol.* 48:444, 1970; Sellers, *SIAM J. Appl. Math.* 26:787, 1974), which allows for amino acid insertions and deletions. Illustrative parameters for FASTA analysis are: ktup=1, gap opening penalty=10, gap extension penalty=1, and substitution matrix=BLOSUM62. These parameters can be introduced into a FASTA program by modifying the scoring matrix file ("SMATRIX"), as explained in Appendix 2 of Pearson, *Meth. Enzymol.* 183:63, 1990.

FASTA can also be used to determine the sequence identity of nucleic acid molecules using a ratio as disclosed above. For nucleotide sequence comparisons, the ktup value can range between one to six, preferably from three to six, most preferably three, with other parameters set as described above.

BRIEF DESCRIPTION OF THE FIGURES

FIGS. 1A-1C illustrate the amino acid sequences of certain immunoglobulin Fc polypeptides. Amino acid sequence numbers are based on the EU index (Kabat et al., *Sequences of Proteins of Immunological Interest*, US Department of Health and Human Services, NIH, Bethesda, 1991). The illustrated sequences include a wild-type human sequence ("wt"; SEQ ID NO: 531) and five variant sequences, designated Fc-488 (SEQ ID NO: 532), Fc4 (SEQ ID NO: 533), Fc5 (SEQ ID NO: 492), Fc6 (SEQ ID NO: 534), and Fc7 (SEQ ID NO: 535). The Cys residues normally involved in disulfide bonding to the light chain constant region (LC) and heavy chain constant region (HC) are indicated. A "." indicates identity to wild-type at that position. *** indicates the stop codon; the C-terminal Lys residue has been removed from Fc6. Boundaries of the hinge, $C_H2$, and $C_H3$ domains are shown.

FIGS. 2A-2C depict tetravalent, bispecific Fc fusion and Mab formats having Fv regions with specificity for two different targets (referred to herein as targets X and Y). Fv domains against target X are indicated by a striped fill, Fv domains against target Y are indicated by a gray fill, and the Ig constant domains are indicated by stippled fill. FIG. 2A shows a tandem single chain Fv Fc fusion (tascFv-Fc); FIG. 2B shows a bi-single chain Fv Fc fusion (biscFv-Fc); and FIG. 2C shows a whole monoclonal antibody with a single chain Fv (scFv) fused to the carboxyl terminus (BiAb).

DESCRIPTION OF THE INVENTION

I. Overview

Figure 3:
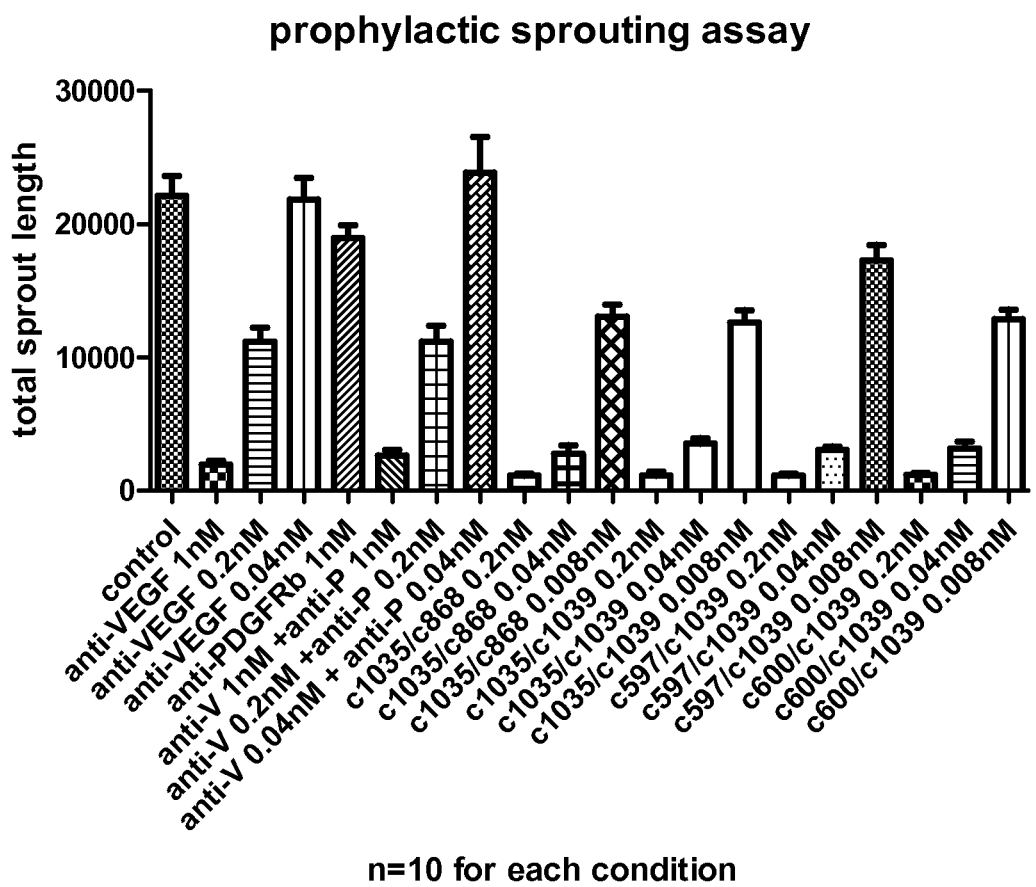
FIG. 3 depicts inhibition of endothelial cell sprouting by PDGFRβ/VEGF-A bispecific antagonists in an in vitro co-culture sprouting assay in a prophylactic setting. Cytodex-3 beads coated with HUVECs were embedded in fibrin gel along with human mesenchymal stem cells and cultured with EGM-2 complete media and D551 fibroblast conditioned media (1:1) with recombinant human HGF. (See Example 75.) Antagonists—anti-VEGF-A (Bevacizumab, Genentech); a combination of anti-VEGF-A+anti-PDGFRβ mAb E9899; or a PDGFRβ/VEGF-A bispecific antibody (c1035/c868 biscFv, c1035/c1039 biscFv, c597/c1039 biAb, or c600/c1039 biAb)—were added to the culture on Day 2 (from start of the co-culture) at the indicated concentrations. 7 days after addition of antagonists, cells were fixed and stained with anti-PECAM or anti-SMA antibodies followed by secondary antibody. Cells were then viewed by an inverted fluorescence microscope and analyzed for endothelial cell sprout length as described in Example 75.

The present invention addresses a need in the art to provide more therapeutics to treat neovascular disorders, including cancers and ocular neovascular disorders. Specifically, the present invention provides VEGF-A and PDGFRβ antagonists, particularly neutralizing anti-VEGF-A and anti-PDGFRβ antibodies, that inhibit signaling through VEGF-A receptors and PDGFRβ. Inhibition of angiogenic signals through VEGF-A and/or PDGFRβ using such antagonists are useful for treatment of various disorders having a pathology characterized at least in part by neovascularization. For example, inhibition of angiogenic signals through VEGF-A and/or PDGFRβ in and around tumors reduces the tumor's ability to vascularize, grow, and metastasize. In addition, inhibition of angiogenic signals through VEGF-A and/or PDGFRβ reduces neovascularization characteristic of various ocular diseases, including, for example, age-related macular degeneration (AMD), diabetic retinopathy, proliferative vitroretinopathy (PVR), iris neovascularization, and neovascular glaucoma. As described herein, VEGF-A and PDGFRβ antagonists of the invention are particularly effective when in combination. Accordingly, in certain preferred embodiments, the invention provides bispecific agents, including bispecific antibodies, that are capable of neutralizing both VEGF-A and PDGFRβ, as well as related methods for using such bispecific agents for treatment of angiogenesis-related disorders.

VEGF-A antagonists for use within the present invention include molecules that bind to VEGF-A or a VEGF-A receptor and thereby reduce the activity of VEGF-A on cells that express the receptor such as, e.g., VEGFR-1, VEGFR-2, neuropilin-1, and/or neuropilin-2. In particular, VEGF-A antagonists include anti-VEGF-A antibodies. Other suitable VEGF-A antagonists include soluble VEGF-A receptors comprising a VEGFR extracellular domain, as well as small molecule antagonists capable of inhibiting the interaction of VEGF-A with its receptor or otherwise capable in inhibiting VEGF-A-induced intracellular signaling through a VEGF-A receptor. In addition, binding proteins based on non-antibody scaffolds may be employed. (See, e.g., Koide et al., *J. Mol. Biol.* 284:1141-1151, 1998; Hosse et al. *Protein Sci.* 15:14-27, 2006, and references therein.) Preferred VEGF-A antagonists for use within the invention include antibodies that specifically bind to VEGF-A, including bispecific antibodies that also comprise a binding site for PDGFRβ. Antibodies that are specific for VEGF-A bind at least the soluble secreted forms of VEGF-A, and preferably also bind cell surface-associated forms.

PDGFRβ antagonists for use within the present invention include molecules that bind to PDGFRβ or its ligands and thereby reduce the activity of PDGF on cells that express the receptor. Ligands for PDGFRβ include PDGF-B, PDGF-C, and PDGF-D. In particular, PDGFRβ antagonists include anti-PDGFRβ antibodies. Other suitable PDGFRβ antagonists include antibodies against PDGFRβ ligands (i.e., antibodies against PDGF-B, PDGF-C, and/or PDGF-D), soluble PDGFRβ, and small molecule antagonists capable of inhibiting the interaction of PDGFRβ with its ligands or otherwise capable of inhibiting intracellular signaling through PDGFRβ. In addition, binding proteins based on non-antibody scaffolds may be employed. (See, e.g., Koide et al., *J. Mol. Biol.* 284:1141-1151, 1998; Hosse et al., *Protein Sci.* 15:14-27, 2006, and references therein.) Preferred PDGFRβ antagonists for use within the invention include antibodies that specifically bind to PDGFRβ, including bispecific antibodies that also comprise a binding site for VEGF-A.

II. Anti-PDGFRβ Antibodies, Anti-VEGF-A Antibodies, and Related Bispecific Binding Compositions In certain preferred embodiments, VEGF-A and/or PDGFRβ antagonists in accordance with the present invention are antibodies that specifically bind to VEGF-A (residues 27-191 SEQ ID NO: 2) and/or the extracellular domain of PDGFRβ (residues 33-531 of SEQ ID NO: 4). Particularly preferred antibodies of the invention neutralize the biological activity of VEGF-A, PDGFRβ, or both VEGF-A and PDGFRβ.

Antibodies are considered to be specifically binding if (1) they exhibit a threshold level of binding activity, and (2) they do not significantly cross-react with control polypeptide molecules. For example, a threshold level of binding is determined if an anti-VEGF-A antibody binds to a VEGF-A polypeptide, peptide or epitope with an affinity at least 10-fold greater than the binding affinity to a control (non-VEGF-A) polypeptide. It is preferred that antibodies used within the invention exhibit a binding affinity ($K_a$) of $10^6$ $M^{-1}$ or greater, preferably $10^7$ $M^{-1}$ or greater, more preferably $10^8$ $M^{-1}$ or greater, and most preferably $10^9$ $M^{-1}$ or greater. The binding affinity of an antibody can be readily determined by one of ordinary skill in the art, commonly by surface plasmon resonance using automated equipment. Other methods are known in the art, for example Scatchard analysis (Scatchard, *Ann. NY Acad. Sci.* 51:660-672, 1949).

Antibodies of the present invention comprise or consist of portions of intact antibodies that retain antigen-binding specificity. Suitable antibodies include, for example, fully human antibodies; humanized antibodies; chimeric antibodies; antibody fragments such as, e.g., Fab, Fab', F(ab)$_2$, F(ab')$_2$ and Fv antibody fragments; single chain antibodies; and monomers or dimers of antibody heavy or light chains or mixtures thereof. Preferred antibodies of the invention are monoclonal antibodies. Antibodies comprising a light chain may comprise kappa or lambda light chain.

In certain embodiments, antibodies of the invention include intact immunoglobulins of any isotype including IgA, IgG, IgE, IgD, or IgM (including subtypes thereof). Intact immunoglobulins in accordance with the present invention preferably include intact IgG (e.g., intact IgG1, IgG2, IgG3, IgG4, IgA1, or IgA2).

Methods for preparing and isolating polyclonal antibodies, monoclonal antibodies, and antigen-binding antibody fragments thereof are well known in the art. See, e.g., *Current Protocols in Immunology*, (Cooligan et al. eds., John Wiley and Sons, Inc. 2006); Sambrook et al., *Molecular Cloning: A Laboratory Manual* (Cold Spring Harbor, N.Y., 2nd ed. 1989); and *Monoclonal Hybridoma Antibodies: Techniques and Applications* (Hurrell ed., CRC Press, Inc., Boca Raton, Fla., 1982). Antigen binding fragments, including scFv, can be prepared using phage display libraries according to methods known in the art. Phage display can also be employed for the preparation of binding proteins based on non-antibody scaffolds (Koide et al., supra.). Methods for preparing recombinant human polyclonal antibodies are disclosed by Wiberg et al., *Biotechnol Bioeng.* 94:396-405, 2006; Meijer et al., *J. Mol. Biol.* 358:764-772, 2006; Haurum et al., U.S. Patent Application Publication No. 2002/0009453; and Haurum et al., U.S. Patent Application Publication No. 2005/0180967. As will be evident to persons of ordinary skill in the art, these methods are equally applicable to production of antibodies against VEGF-A, VEGF-A receptors, PDGFRβ, and PDGF ligands.

As would be evident to one of ordinary skill in the art, polyclonal antibodies for use within the present invention can be generated by inoculating any of a variety of warm-blooded animals such as horses, cows, goats, sheep, dogs, chickens, rabbits, mice, and rats with an immunogenic polypeptide or polypeptide fragment. The immunogenicity of an immunogenic polypeptide can be increased through the use of an adjuvant, such as alum (aluminum hydroxide) or Freund's complete or incomplete adjuvant. Polypeptides useful for immunization also include fusion polypeptides, such as fusions of VEGF-A, PDGFRβ, or a portion thereof with an immunoglobulin polypeptide or with maltose binding protein. The polypeptide immunogen may be a full-length molecule or a portion thereof. If the polypeptide portion is hapten-like, it may be advantageously joined or linked to a macromolecular carrier (such as keyhole limpet hemocyanin (KLH), bovine serum albumin (BSA) or tetanus toxoid) for immunization.

In addition, antibodies can be screened against known polypeptides related to the antibody target (e.g., orthologs, paralogs, or sequence variants of, for example, VEGF-A or PDGFRβ) to isolate a population of antibodies that is highly specific for binding to the target protein or polypeptide. Such highly specific populations include, for example, antibodies that bind to human VEGF-A but not to mouse VEGF-A. Such a lack of cross-reactivity with related polypeptide molecules is shown, for example, by the antibody detecting a VEGF-A polypeptide but not known, related polypeptides using a standard Western blot analysis (*Current Protocols in Molecular Biology* (Ausubel et al. eds., Green and Wiley and Sons, NY 1993)) or ELISA (enzyme immunoassay) (*Immunoassay, A Practical Guide* (Chan ed., Academic Press, Inc. 1987)). In another example, antibodies raised to a VEGF-A polypeptide are adsorbed to related polypeptides adhered to insoluble matrix; antibodies that are highly specific to the VEGF-A polypeptide will flow through the matrix under the proper buffer conditions. Screening allows isolation of polyclonal and monoclonal antibodies non-cross-reactive to known, closely related polypeptides (*Antibodies: A Laboratory Manual*(Harlow and Lane eds., Cold Spring Harbor Laboratory Press 1988); *Current Protocols in Immunology* (Cooligan et al. eds., National Institutes of Health, John Wiley and Sons, Inc. 1995). Screening and isolation of specific antibodies is well known in the art. See *Fundamental Immunology* (Paul ed., Raven Press 1993); Getzoff et al., *Adv. in Immunol.* 43:1-98, 1988; *Monoclonal Antibodies: Principles and Practice* (Goding ed., Academic Press Ltd. 1996); Benjamin et al., *Ann. Rev. Immunol.* 2:67-101, 1984.

Native monoclonal antibodies ("mAbs") can be prepared, for example, by immunizing subject animals (e.g., rats or mice) with a purified immunogenic protein or fragment thereof. In a typical procedure, animals are each given an initial intraperitoneal (IP) injection of the purified protein or fragment, typically in combination with an adjuvant (e.g., Complete Freund's Adjuvant or RIBI Adjuvant (available from Sigma-Aldrich, St. Louis, Mo.)) followed by booster IP injections of the purified protein at, for example, two-week intervals. Seven to ten days after the administration of the third booster injection, the animals are bled and the serum is collected. Additional boosts can be given as necessary. Splenocytes and lymphatic node cells are harvested from high-titer animals and fused to myeloma cells (e.g., mouse SP2/0 or Ag8 cells) using conventional methods. The fusion mixture is then cultured on a feeder layer of thymocytes or cultured with appropriate medium supplements (including commercially available supplements such as Hybridoma Fusion and Cloning Supplement; Roche Diagnostics, Indianapolis, Ind.). About 10 days post-fusion, specific antibody-producing hybridoma pools are identified using standard assays (e.g., ELISA). Positive pools may be analyzed further for their ability to block or reduce the activity of the target protein. Positive pools are cloned by limiting dilution.

In certain aspects, the invention also includes the use of multiple monoclonal antibodies that are specific for different epitopes on a single target molecule. Use of such multiple antibodies in combination can reduce carrier effects seen with single antibodies and may also increase rates of clearance via the Fc receptor and improve ADCC. Two, three, or more monoclonal antibodies can be used in combination.

The amino acid sequence of a native antibody can be varied through the application of recombinant DNA techniques. Thus, antibodies can be redesigned to obtain desired characteristics. Modified antibodies can provide, for example, improved stability and/or therapeutic efficacy relative to its non-modified form. The possible variations are many and range from the changing of just one or a few amino acids to the complete redesign of, for example, the variable or constant region. Changes in the constant region will, in general, be made in order to improve or alter characteristics, such as complement fixation, interaction with membranes, and other effector functions. Examples of engineered constant region sequences are shown in FIGS. 1A-1C (SEQ ID NOs: 492 and 532-535). Typically, changes in the variable region will be made in order to improve the antigen binding characteristics, improve variable region stability, or reduce the risk of immunogenicity. Phage display techniques can also be employed. See, e.g., Huse et al., *Science* 246:1275-1281, 1989; Ladner et al., U.S. Pat. No. 5,571,698.

For therapeutic antibodies for use in humans, it is usually desirable to humanize non-human regions of an antibody according to known procedures. Methods of making humanized antibodies are disclosed, for example, in U.S. Pat. Nos. 5,530,101; 5,821,337; 5,585,089; 5,693,762; and 6,180,370. Typically, a humanized anti-PDGFRβ or anti-VEGF-A antibody comprises the complementarity determining regions (CDRs) of a mouse donor immunoglobulin and heavy chain and light chain frameworks of a human acceptor immunoglobulin. Often, framework residues in the human framework regions will be substituted with the corresponding residue from the CDR donor antibody to alter, preferably improve, antigen binding. These framework substitutions are identified by methods well known in the art, e.g., by modeling of the interactions of the CDR and framework residues to identify framework residues important for antigen binding and sequence comparison to identify unusual framework residues at particular positions. (See, e.g., Queen et al., U.S. Pat. No. 5,585,089; Riechmann et al., *Nature* 332:323, 1988).

Non-humanized chimeric antibodies can also be used therapeutically (e.g., in immunosuppressed patients). Accordingly, in some variations, an antibody in accordance with the present invention is a chimeric antibody derived, inter alia, from a non-human anti-PDGFRβ or anti-VEGF-A antibody. Preferably, a chimeric antibody comprises a variable region derived from a mouse or rat antibody and a constant region derived from a human so that the chimeric antibody has a longer half-life and is less immunogenic when administered to a human subject. Methods for producing chimeric antibodies are known in the art. (See e.g., Morrison, *Science* 229:1202, 1985; Oi et al., *BioTechniques* 4:214, 1986; Gillies et al., *J. Immunol. Methods* 125:191-202, 1989; U.S. Pat. Nos. 5,807,715; 4,816,567; and 4,816,397.)

The present invention also encompasses fully human antibodies such as those derived from peripheral blood mononuclear cells of ovarian, breast, renal, colorectal, lung, endometrial, or brain cancer patients. Such cells may be fused with myeloma cells, for example, to form hybridoma cells producing fully human antibodies against PDGFRβ or VEGF-A. Human antibodies can also be made in transgenic, non-human animals, commonly mice. See, e.g., Tomizuka et al., U.S. Pat. No. 7,041,870. In general, a nonhuman mammal is made transgenic for a human heavy chain locus and a human light chain locus, and the corresponding endogenous immunoglobulin loci are inactivated.

Antibodies of the present invention may be specified in terms of an epitope or portion of a VEGF-A or PDGFRβ polypeptide that they recognize or specifically bind. An epitope or polypeptide portion may be specified, e.g., by N-terminal and C-terminal positions of the epitope or other portion of the VEGF-A polypeptide shown in SEQ ID NO: 2 or of the PDGFRβ polypeptide shown in SEQ ID NO: 4.

The antibodies of the invention have binding affinities that include a dissociation constant ($K_d$) less than $5\times10^{-2}$ M, less than $10^{-2}$M, less than $5\times10^{-3}$ M, less than $10^{-3}$ M, less than $5\times10^{-4}$ M, less than $10^{-4}$ M, less than $5\times10^{-5}$ M, less than $10^{-5}$ M, less than $5\times10^{-6}$ M, less than $10^{-6}$ M, less than $5\times10^{-7}$ M, less than $10^{-7}$ M, less than $5\times10^{-8}$ M, less than $10^{-8}$ M, less than $5\times10^{-9}$ M, less than $10^{-9}$ M, less than $5 \times 10^{-10}$ M, less than $10^{-10}$ M, less than $5 \times 10^{-11}$ M, less than $10^{-11}$ M, less than $5 \times 10^{-12}$ M, less than $10^{-12}$ M, less than $5 \times 10^{-13}$ M, less than $10^{-13}$ M, less than $5 \times 10^{-14}$ M, less than $10^{-14}$ M, less than $5 \times 10^{-15}$ M, or less than $10^{-15}$ M.

Antibodies of the present invention further include derivatives that are modified, e.g., by the covalent attachment of any type of molecule to the antibody such that covalent attachment does not prevent the antibody from binding to its epitope. Suitable modifications include, for example, fucosylation, glycosylation, acetylation, pegylation, phosphorylation, and amidation. The antibodies and derivatives thereof may themselves by derivatized by known protecting/blocking groups, proteolytic cleavage, linkage to a cellular ligand or other proteins, and the like. In some embodiments of the invention, at least one heavy chain of the antibody is fucosylated. In particular variations, the fucosylation is N-linked. In some certain preferred embodiments, at least one heavy chain of the antibody comprises a fucosylated, N-linked oligosaccharide.

Antibodies of the present invention may be used alone or as immunoconjugates with a cytotoxic agent. In some embodiments, the agent is a chemotherapeutic agent. In other embodiments, the agent is a radioisotope such as, for example, Lead-212, Bismuth-212, Astatine-211, Iodine-131, Scandium-47, Rhenium-186, Rhenium-188, Yttrium-90, Iodine-123, Iodine-125, Bromine-77, Indium-111, or a fissionable nuclide such as Boron-10 or an Actinide. In yet other embodiments, the agent is a toxin or cytotoxic drug such as, for example, ricin, modified *Pseudomonas* enterotoxin A, calicheamicin, adriamycin, 5-fluorouracil, an auristatin (e.g., auristatin E), maytansin, or the like. Methods of conjugation of antibodies and antibody fragments to such agents are known in the art.

Antibodies of the present invention include variants having single or multiple amino acid substitutions, deletions, additions, or replacements relative to a reference antibody (e.g., a reference antibody having VL and/or VH sequences as shown in Table 2 or Table 4), such that the variant retains one or more biological properties of the reference antibody (e.g., block the binding of PDGFRβ and/or VEGF-A to their respective counter-structures (a PDGF ligand or VEGF-A receptor), block the biological activity of PDGFRβ and/or VEGF-A, binding affinity). The skilled person can produce variants having single or multiple amino acid substitutions, deletions, additions, or replacements. These variants may include, for example: (a) variants in which one or more amino acid residues are substituted with conservative or nonconservative amino acids, (b) variants in which one or more amino acids are added to or deleted from the polypeptide, (c) variants in which one or more amino acids include a substituent group, and (d) variants in which the polypeptide is fused with another peptide or polypeptide such as a fusion partner, a protein tag or other chemical moiety, that may confer useful properties to the polypeptide, such as, for example, an epitope for an antibody, a polyhistidine sequence, a biotin moiety, and the like. Antibodies of the invention may include variants in which amino acid residues from one species are substituted for the corresponding residue in another species, either at the conserved or nonconserved positions. In another embodiment, amino acid residues at nonconserved positions are substituted with conservative or nonconservative residues. The techniques for obtaining these variants, including genetic (suppressions, deletions, mutations, etc.), chemical, and enzymatic techniques, are known to the person having ordinary skill in the art.

The present invention also encompasses bispecific antibodies that bind to both PDGFRβ and VEGF-A. Such bispecific PDGFRβ/VEGF-A antibodies are described further herein.

Exemplary antibodies that bind to PDGFRβ and VEGF-A have been identified by screening a phage display library. Methods of screening by phage display are described in detail in standard reference texts, such as Babas, *Phage Display: A Laboratory Manual* (Cold Spring Harbor Lab Press, 2001) and Lo, Benny K. C., A., *Antibody Engineering* (2004). Such phage display libraries can be used to display expressed proteins on the surface of a cell or other substance such that the complementary binding entity can be functionally isolated. In one such phage display library, the antibody light-chain variable region and a portion of the heavy-chain variable region are combined with synthetic DNA encoding human antibody sequences, which are then displayed on phage and phagemid libraries as Fab antibody fragments (Dyax® Human Antibody Libraries, Dyax Corp., Cambridge, Mass.). Thus, the variable light and heavy chain fragments of antibodies can be isolated in a Fab format. These variable regions can then be manipulated to generate antibodies, including antigen-binding fragments, such as scFvs, bispecific scFvs, and multispecific, multifunctional antagonists to PDGFRβ and/or VEGF-A.

Using this technology, the variable regions of exemplary Fabs have been identified for their characteristics of binding and/or neutralizing either PDGFRβ or VEGF-A in assays described herein. (See Examples, infra.) These variable regions were manipulated to generate various binding entities, including scFvs that bind and/or neutralize PDGFRβ or VEGF-A. Tables 2 and 4 below show nucleotide and amino acid SEQ ID NO. designations for anti-PDGFRβ and anti-VEGF-A antibody clusters identified for their ability to bind and neutralize either PDGFRβ and VEGF-A, while Tables 3 and 5 list the amino acid residue positions corresponding to the framework and CDR regions of the anti-PDGFRβ and anti-VEGF-A antibodies listed in Tables 2 and 4.

TABLE 2

SEQ ID NO. Designations for anti-PDGFRβ Antibody Clusters

| Cluster # | $V_L$ nucleotide SEQ ID NO: | $V_L$ polypeptide SEQ ID NO: | $V_H$ nucleotide SEQ ID NO: | $V_H$ polypeptide SEQ ID NO: |
|---|---|---|---|---|
| 597 | 5 | 6 | 7 | 8 |
| 600 | 9 | 10 | 11 | 12 |
| 607 | 13 | 14 | 15 | 16 |
| 613 | 17 | 18 | 19 | 20 |
| 941 | 21 | 22 | 23 | 24 |
| 946 | 25 | 26 | 27 | 28 |
| 947 | 29 | 30 | 31 | 32 |
| 949 | 33 | 34 | 35 | 36 |
| 975 | 37 | 38 | 39 | 40 |
| 997 | 41 | 42 | 43 | 44 |
| 1035 | 45 | 46 | 47 | 48 |
| 1223 | 49 | 50 | 51 | 52 |
| 1228 | 53 | 54 | 55 | 56 |
| 1230 | 57 | 58 | 59 | 60 |
| 1231 | 61 | 62 | 63 | 64 |
| 1236 | 65 | 66 | 67 | 68 |
| 1238 | 69 | 70 | 71 | 72 |
| 1244 | 73 | 74 | 75 | 76 |
| 1245 | 77 | 78 | 79 | 80 |
| 1299 | 81 | 82 | 83 | 84 |
| 1312 | 85 | 86 | 87 | 88 |
| 1314 | 89 | 90 | 91 | 92 |
| 1317 | 93 | 94 | 95 | 96 |
| 1322 | 97 | 98 | 99 | 100 |
| 1323 | 101 | 102 | 103 | 104 |

TABLE 2-continued

SEQ ID NO. Designations for anti-PDGFRβ Antibody Clusters

| Cluster # | $V_L$ nucleotide SEQ ID NO: | $V_L$ polypeptide SEQ ID NO: | $V_H$ nucleotide SEQ ID NO: | $V_H$ polypeptide SEQ ID NO: |
|---|---|---|---|---|
| 1330 | 105 | 106 | 107 | 108 |
| 1334 | 109 | 110 | 111 | 112 |
| 1345 | 113 | 114 | 115 | 116 |
| 1346 | 117 | 118 | 119 | 120 |
| 1359 | 121 | 122 | 123 | 124 |
| 1365 | 125 | 126 | 127 | 128 |
| 1402 | 129 | 130 | 131 | 132 |
| 1515 | 133 | 134 | 135 | 136 |
| 1531 | 137 | 138 | 139 | 140 |
| 1535 | 141 | 142 | 143 | 144 |
| 1541 | 145 | 146 | 147 | 148 |
| 1550 | 149 | 150 | 151 | 152 |
| 1564 | 153 | 154 | 155 | 156 |
| 1601 | 157 | 158 | 159 | 160 |
| 1629 | 161 | 162 | 163 | 164 |

TABLE 4

SEQ ID NO. Designations for anti-VEGF-A Antibody Clusters

| Cluster # | $V_L$ nucleotide SEQ ID NO: | $V_L$ polypeptide SEQ ID NO: | $V_H$ nucleotide SEQ ID NO: | $V_H$ polypeptide SEQ ID NO: |
|---|---|---|---|---|
| 635 | 165 | 166 | 167 | 168 |
| 636 | 169 | 170 | 171 | 172 |
| 638 | 173 | 174 | 175 | 176 |
| 656 | 177 | 178 | 179 | 180 |
| 665 | 181 | 182 | 183 | 184 |
| 668 | 185 | 186 | 187 | 188 |
| 669 | 189 | 190 | 191 | 192 |
| 679 | 193 | 194 | 195 | 196 |
| 695 | 197 | 198 | 199 | 200 |
| 709 | 201 | 202 | 203 | 204 |
| 710 | 205 | 206 | 207 | 208 |
| 741 | 209 | 210 | 211 | 212 |
| 752 | 213 | 214 | 215 | 216 |
| 772 | 217 | 218 | 219 | 220 |
| 779 | 221 | 222 | 223 | 224 |
| 799 | 225 | 226 | 227 | 228 |

TABLE 3

Amino Acid Residue Positions* Corresponding to Framework and CDR Regions of anti-PDGFRβ Antibodies

| Cluster # | VL FR1 range | VL CDR1 range | VL FR2 range | VL CDR2 range | VL FR3 range | VL CDR3 range | VL FR4 range | VH FR1 range | VH CDR1 range | VH FR2 range | VH CDR2 range | VH FR3 range | VH CDR3 range | VH FR4 range |
|---|---|---|---|---|---|---|---|---|---|---|---|---|---|---|
| 597 | 1-23 | 24-40 | 41-55 | 56-62 | 63-94 | 95-103 | 104-113 | 1-30 | 31-35 | 36-49 | 50-66 | 67-98 | 99-110 | 111-121 |
| 600 | 1-23 | 24-40 | 41-55 | 56-62 | 63-94 | 95-103 | 104-113 | 1-30 | 31-35 | 36-49 | 50-66 | 67-98 | 99-110 | 111-121 |
| 607 | 1-23 | 24-40 | 41-55 | 56-62 | 63-94 | 95-103 | 104-113 | 1-30 | 31-35 | 36-49 | 50-66 | 67-98 | 99-110 | 111-121 |
| 613 | 1-23 | 24-34 | 35-49 | 50-56 | 57-88 | 89-97 | 98-107 | 1-30 | 31-35 | 36-49 | 50-66 | 67-98 | 99-115 | 116-126 |
| 941 | 1-23 | 24-40 | 41-55 | 56-62 | 63-94 | 95-103 | 104-113 | 1-30 | 31-35 | 36-49 | 50-66 | 67-98 | 99-111 | 112-122 |
| 946 | 1-23 | 24-40 | 41-55 | 56-62 | 63-94 | 95-103 | 104-113 | 1-30 | 31-35 | 36-49 | 50-66 | 67-98 | 99-110 | 111-121 |
| 947 | 1-23 | 24-40 | 41-55 | 56-62 | 63-94 | 95-103 | 104-113 | 1-30 | 31-35 | 36-49 | 50-66 | 67-98 | 99-110 | 111-121 |
| 949 | 1-23 | 24-40 | 41-55 | 56-62 | 63-94 | 95-103 | 104-113 | 1-30 | 31-35 | 36-49 | 50-66 | 67-98 | 99-110 | 111-121 |
| 975 | 1-23 | 24-40 | 41-55 | 56-62 | 63-94 | 95-103 | 104-113 | 1-30 | 31-35 | 36-49 | 50-66 | 67-98 | 99-110 | 111-121 |
| 997 | 1-23 | 24-40 | 41-55 | 56-62 | 63-94 | 95-103 | 104-113 | 1-30 | 31-35 | 36-49 | 50-66 | 67-98 | 99-110 | 111-121 |
| 1035 | 1-23 | 24-40 | 41-55 | 56-62 | 63-94 | 95-103 | 104-113 | 1-30 | 31-35 | 36-49 | 50-66 | 67-98 | 99-111 | 112-122 |
| 1223 | 1-23 | 24-40 | 41-55 | 56-62 | 63-94 | 95-103 | 104-113 | 1-30 | 31-35 | 36-49 | 50-66 | 67-98 | 99-110 | 111-121 |
| 1228 | 1-23 | 24-40 | 41-55 | 56-62 | 63-94 | 95-103 | 104-113 | 1-30 | 31-35 | 36-49 | 50-66 | 67-98 | 99-110 | 111-121 |
| 1230 | 1-23 | 24-40 | 41-55 | 56-62 | 63-94 | 95-103 | 104-113 | 1-30 | 31-35 | 36-49 | 50-66 | 67-98 | 99-111 | 112-122 |
| 1231 | 1-23 | 24-40 | 41-55 | 56-62 | 63-94 | 95-103 | 104-113 | 1-30 | 31-35 | 36-49 | 50-66 | 67-98 | 99-110 | 111-121 |
| 1236 | 1-23 | 24-40 | 41-55 | 56-62 | 63-94 | 95-103 | 104-113 | 1-30 | 31-35 | 36-49 | 50-66 | 67-98 | 99-111 | 112-122 |
| 1238 | 1-23 | 24-40 | 41-55 | 56-62 | 63-94 | 95-103 | 104-113 | 1-30 | 31-35 | 36-49 | 50-66 | 67-98 | 99-110 | 111-121 |
| 1244 | 1-23 | 24-40 | 41-55 | 56-62 | 63-94 | 95-103 | 104-113 | 1-30 | 31-35 | 36-49 | 50-66 | 67-98 | 99-110 | 111-121 |
| 1245 | 1-23 | 24-40 | 41-55 | 56-62 | 63-94 | 95-103 | 104-113 | 1-30 | 31-35 | 36-49 | 50-66 | 67-98 | 99-110 | 111-121 |
| 1299 | 1-23 | 24-40 | 41-55 | 56-62 | 63-94 | 95-103 | 104-113 | 1-30 | 31-35 | 36-49 | 50-66 | 67-98 | 99-111 | 112-122 |
| 1312 | 1-23 | 24-40 | 41-55 | 56-62 | 63-94 | 95-103 | 104-113 | 1-30 | 31-35 | 36-49 | 50-66 | 67-98 | 99-111 | 112-122 |
| 1314 | 1-23 | 24-40 | 41-55 | 56-62 | 63-94 | 95-103 | 104-113 | 1-30 | 31-35 | 36-49 | 50-66 | 67-98 | 99-110 | 111-121 |
| 1317 | 1-23 | 24-40 | 41-55 | 56-62 | 63-94 | 95-103 | 104-113 | 1-30 | 31-35 | 36-49 | 50-66 | 67-98 | 99-110 | 111-121 |
| 1322 | 1-23 | 24-40 | 41-55 | 56-62 | 63-94 | 95-103 | 104-113 | 1-30 | 31-35 | 36-49 | 50-66 | 67-98 | 99-110 | 111-121 |
| 1323 | 1-23 | 24-40 | 41-55 | 56-62 | 63-94 | 95-103 | 104-113 | 1-30 | 31-35 | 36-49 | 50-66 | 67-98 | 99-110 | 111-121 |
| 1330 | 1-23 | 24-40 | 41-55 | 56-62 | 63-94 | 95-103 | 104-113 | 1-30 | 31-35 | 36-49 | 50-66 | 67-98 | 99-110 | 111-121 |
| 1334 | 1-23 | 24-40 | 41-55 | 56-62 | 63-94 | 95-103 | 104-113 | 1-30 | 31-35 | 36-49 | 50-66 | 67-98 | 99-110 | 111-121 |
| 1345 | 1-23 | 24-40 | 41-55 | 56-62 | 63-94 | 95-103 | 104-113 | 1-30 | 31-35 | 36-49 | 50-66 | 67-98 | 99-110 | 111-121 |
| 1346 | 1-23 | 24-40 | 41-55 | 56-62 | 63-94 | 95-103 | 104-113 | 1-30 | 31-35 | 36-49 | 50-66 | 67-98 | 99-111 | 112-122 |
| 1359 | 1-23 | 24-40 | 41-55 | 56-62 | 63-94 | 95-103 | 104-113 | 1-30 | 31-35 | 36-49 | 50-66 | 67-98 | 99-111 | 112-122 |
| 1365 | 1-23 | 24-40 | 41-55 | 56-62 | 63-94 | 95-103 | 104-113 | 1-30 | 31-35 | 36-49 | 50-66 | 67-98 | 99-111 | 112-122 |
| 1402 | 1-23 | 24-40 | 41-55 | 56-62 | 63-94 | 95-103 | 104-113 | 1-30 | 31-35 | 36-49 | 50-66 | 67-98 | 99-111 | 112-122 |
| 1515 | 1-23 | 24-40 | 41-55 | 56-62 | 63-94 | 95-103 | 104-113 | 1-30 | 31-35 | 36-49 | 50-66 | 67-98 | 99-110 | 111-121 |
| 1531 | 1-23 | 24-40 | 41-55 | 56-62 | 63-94 | 95-103 | 104-113 | 1-30 | 31-35 | 36-49 | 50-66 | 67-98 | 99-111 | 112-120 |
| 1535 | 1-23 | 24-40 | 41-55 | 56-62 | 63-94 | 95-103 | 104-113 | 1-30 | 31-35 | 36-49 | 50-66 | 67-98 | 99-110 | 111-121 |
| 1541 | 1-23 | 24-40 | 41-55 | 56-62 | 63-94 | 95-103 | 104-113 | 1-30 | 31-35 | 36-49 | 50-66 | 67-98 | 99-110 | 111-121 |
| 1550 | 1-23 | 24-40 | 41-55 | 56-62 | 63-94 | 95-103 | 104-113 | 1-30 | 31-35 | 36-49 | 50-66 | 67-98 | 99-110 | 111-121 |
| 1564 | 1-23 | 24-40 | 41-55 | 56-62 | 63-94 | 95-103 | 104-113 | 1-30 | 31-35 | 36-49 | 50-66 | 67-98 | 99-111 | 112-122 |
| 1601 | 1-23 | 24-40 | 41-55 | 56-62 | 63-94 | 95-103 | 104-113 | 1-30 | 31-35 | 36-49 | 50-66 | 67-98 | 99-111 | 112-122 |
| 1629 | 1-23 | 24-40 | 41-55 | 56-62 | 63-94 | 95-103 | 104-113 | 1-30 | 31-35 | 36-49 | 50-66 | 67-98 | 99-111 | 112-122 |

*Residue position numbers shown (indicated as a "range" of residue positions of either the variable light (VL) or variable heavy (VH) chain polypeptide) are according to VL or VH polypeptide sequences for the corresponding antibody cluster number, the amino acid SEQ ID NOs: for which are indicated in Table 2.

TABLE 4-continued

SEQ ID NO. Designations for anti-VEGF-A Antibody Clusters

| Cluster # | $V_L$ nucleotide SEQ ID NO: | $V_L$ polypeptide SEQ ID NO: | $V_H$ nucleotide SEQ ID NO: | $V_H$ polypeptide SEQ ID NO: |
|---|---|---|---|---|
| 830 | 229 | 230 | 231 | 232 |
| 844 | 233 | 234 | 235 | 236 |
| 847 | 237 | 238 | 239 | 240 |
| 868 | 241 | 242 | 243 | 244 |
| 870 | 245 | 246 | 247 | 248 |
| 883 | 249 | 250 | 251 | 252 |
| 887 | 253 | 254 | 255 | 256 |
| 901 | 257 | 258 | 259 | 260 |
| 905 | 261 | 262 | 263 | 264 |
| 909 | 265 | 266 | 267 | 268 |
| 928 | 269 | 270 | 271 | 272 |
| 1036 | 273 | 274 | 275 | 276 |
| 1039 | 277 | 278 | 279 | 280 |
| 1040 | 281 | 282 | 283 | 284 |
| 1044 | 285 | 286 | 287 | 288 |
| 1048 | 289 | 290 | 291 | 292 |
| 1056 | 293 | 294 | 295 | 296 |
| 1064 | 297 | 298 | 299 | 300 |
| 1080 | 301 | 302 | 303 | 304 |
| 1092 | 305 | 306 | 307 | 308 |
| 1094 | 309 | 310 | 311 | 312 |
| 1096 | 313 | 314 | 315 | 316 |
| 1107 | 317 | 318 | 319 | 320 |
| 1111 | 321 | 322 | 323 | 324 |
| 1123 | 325 | 326 | 327 | 328 |
| 1135 | 329 | 330 | 331 | 332 |
| 1142 | 333 | 334 | 335 | 336 |
| 1155 | 337 | 338 | 339 | 340 |
| 1250 | 341 | 342 | 343 | 344 |
| 1252 | 345 | 346 | 347 | 348 |
| 1254 | 349 | 350 | 351 | 352 |
| 1257 | 353 | 354 | 355 | 356 |
| 1264 | 357 | 358 | 359 | 360 |
| 1266 | 361 | 362 | 363 | 364 |
| 1268 | 365 | 366 | 367 | 368 |
| 1269 | 369 | 370 | 371 | 372 |
| 1270 | 373 | 374 | 375 | 376 |
| 1281 | 377 | 378 | 379 | 380 |
| 1283 | 381 | 382 | 383 | 384 |
| 1285 | 385 | 386 | 387 | 388 |
| 1409 | 389 | 390 | 391 | 392 |
| 1410 | 393 | 394 | 395 | 396 |
| 1413 | 397 | 398 | 399 | 400 |
| 1416 | 401 | 402 | 403 | 404 |
| 1420 | 405 | 406 | 407 | 408 |
| 1428 | 409 | 410 | 411 | 412 |
| 1437 | 413 | 414 | 415 | 416 |
| 1449 | 417 | 418 | 419 | 420 |
| 1458 | 421 | 422 | 423 | 424 |
| 1476 | 425 | 426 | 427 | 428 |
| 1479 | 429 | 430 | 431 | 432 |

TABLE 5

Amino Acid Residue Positions** Corresponding to Framework and CDR Regions of anti-VEGF-A Antibodies

| Cluster # | Light FR1 range | Light CDR1 range | Light FR2 range | Light CDR2 range | Light FR3 range | Light CDR3 range | Light FR4 range | Heavy FR1 range | Heavy CDR1 range | Heavy FR2 range | Heavy CDR2 range | Heavy FR3 range | Heavy CDR3 range | Heavy FR4 range |
|---|---|---|---|---|---|---|---|---|---|---|---|---|---|---|
| 635 | 1-23 | 24-34 | 35-49 | 50-56 | 57-88 | 89-97 | 98-107 | 1-30 | 31-35 | 36-49 | 50-66 | 67-98 | 99-110 | 111-121 |
| 636 | 1-23 | 24-34 | 35-49 | 50-56 | 57-88 | 89-97 | 98-107 | 1-30 | 31-35 | 36-49 | 50-66 | 67-98 | 99-102 | 103-113 |
| 638 | 1-23 | 24-34 | 35-49 | 50-56 | 57-88 | 89-97 | 98-107 | 1-30 | 31-35 | 36-49 | 50-66 | 67-98 | 99-110 | 111-121 |
| 656 | 1-23 | 24-34 | 35-49 | 50-56 | 57-88 | 89-97 | 98-107 | 1-30 | 31-35 | 36-49 | 50-66 | 67-98 | 99-110 | 111-121 |
| 665 | 1-23 | 24-34 | 35-49 | 50-56 | 57-88 | 89-97 | 98-107 | 1-30 | 31-35 | 36-49 | 50-66 | 67-98 | 99-110 | 111-121 |
| 668 | 1-23 | 24-34 | 35-49 | 50-56 | 57-88 | 89-97 | 98-107 | 1-30 | 31-35 | 36-49 | 50-66 | 67-98 | 99-110 | 111-121 |
| 669 | 1-23 | 24-34 | 35-49 | 50-56 | 57-88 | 89-97 | 98-107 | 1-30 | 31-35 | 36-49 | 50-66 | 67-98 | 99-110 | 111-121 |
| 679 | 1-23 | 24-34 | 35-49 | 50-56 | 57-88 | 89-97 | 98-107 | 1-30 | 31-35 | 36-49 | 50-66 | 67-98 | 99-110 | 111-121 |
| 695 | 1-23 | 24-34 | 35-49 | 50-56 | 57-88 | 89-97 | 98-107 | 1-30 | 31-35 | 36-49 | 50-66 | 67-98 | 99-110 | 111-121 |
| 709 | 1-23 | 24-34 | 35-49 | 50-56 | 57-88 | 89-97 | 98-107 | 1-30 | 31-35 | 36-49 | 50-66 | 67-98 | 99-110 | 111-121 |
| 710 | 1-23 | 24-34 | 35-49 | 50-56 | 57-88 | 89-97 | 98-107 | 1-30 | 31-35 | 36-49 | 50-66 | 67-98 | 99-110 | 111-121 |
| 741 | 1-23 | 24-34 | 35-49 | 50-56 | 57-88 | 89-97 | 98-107 | 1-30 | 31-35 | 36-49 | 50-66 | 67-98 | 99-110 | 111-121 |
| 752 | 1-22 | 23-35 | 36-50 | 51-57 | 58-89 | 90-100 | 101-110 | 1-30 | 31-35 | 36-49 | 50-66 | 67-98 | 99-110 | 111-121 |
| 772 | 1-23 | 24-34 | 35-49 | 50-56 | 57-88 | 89-97 | 98-107 | 1-30 | 31-35 | 36-49 | 50-66 | 67-98 | 99-110 | 111-121 |
| 779 | 1-23 | 24-34 | 35-49 | 50-56 | 57-88 | 89-97 | 98-107 | 1-30 | 31-35 | 36-49 | 50-66 | 67-98 | 99-110 | 111-121 |
| 799 | 1-23 | 24-34 | 35-49 | 50-56 | 57-88 | 89-97 | 98-107 | 1-30 | 31-35 | 36-49 | 50-66 | 67-98 | 99-110 | 111-121 |
| 830 | 1-23 | 24-34 | 35-49 | 50-56 | 57-88 | 89-96 | 97-106 | 1-30 | 31-35 | 36-49 | 50-66 | 67-98 | 99-110 | 111-121 |
| 844 | 1-22 | 23-35 | 36-50 | 51-57 | 58-89 | 90-100 | 101-110 | 1-30 | 31-35 | 36-49 | 50-66 | 67-98 | 99-102 | 103-113 |
| 847 | 1-23 | 24-34 | 35-49 | 50-56 | 57-88 | 89-97 | 98-107 | 1-30 | 31-35 | 36-49 | 50-66 | 67-98 | 99-110 | 111-121 |
| 868 | 1-23 | 24-34 | 35-49 | 50-56 | 57-88 | 89-97 | 98-107 | 1-30 | 31-35 | 36-49 | 50-66 | 67-98 | 99-107 | 108-118 |
| 870 | 1-22 | 23-35 | 36-50 | 51-57 | 58-89 | 90-100 | 101-110 | 1-30 | 31-35 | 36-49 | 50-66 | 67-98 | 99-102 | 103-113 |
| 883 | 1-23 | 24-34 | 35-49 | 50-56 | 57-88 | 89-97 | 98-107 | 1-30 | 31-35 | 36-49 | 50-66 | 67-98 | 99-110 | 111-121 |
| 887 | 1-23 | 24-34 | 35-49 | 50-56 | 57-88 | 89-96 | 97-106 | 1-30 | 31-35 | 36-49 | 50-66 | 67-98 | 99-110 | 111-121 |
| 901 | 1-23 | 24-34 | 35-49 | 50-56 | 57-88 | 89-97 | 98-107 | 1-30 | 31-35 | 36-49 | 50-66 | 67-98 | 99-110 | 111-121 |
| 905 | 1-23 | 24-34 | 35-49 | 50-56 | 57-88 | 89-97 | 98-107 | 1-30 | 31-35 | 36-49 | 50-66 | 67-98 | 99-110 | 111-121 |
| 909 | 1-23 | 24-34 | 35-49 | 50-56 | 57-88 | 89-97 | 98-107 | 1-30 | 31-35 | 36-49 | 50-66 | 67-98 | 99-110 | 111-121 |
| 928 | 1-23 | 24-34 | 35-49 | 50-56 | 57-88 | 89-97 | 98-107 | 1-30 | 31-35 | 36-49 | 50-66 | 67-98 | 99-110 | 111-121 |
| 1036 | 1-22 | 23-35 | 36-50 | 51-57 | 58-89 | 90-100 | 101-110 | 1-30 | 31-35 | 36-49 | 50-66 | 67-98 | 99-102 | 103-113 |
| 1039 | 1-23 | 24-34 | 35-49 | 50-56 | 57-88 | 89-97 | 98-107 | 1-30 | 31-35 | 36-49 | 50-66 | 67-98 | 99-110 | 111-121 |
| 1040 | 1-23 | 24-34 | 35-49 | 50-56 | 57-88 | 89-97 | 98-107 | 1-30 | 31-35 | 36-49 | 50-66 | 67-98 | 99-107 | 108-118 |
| 1044 | 1-22 | 23-35 | 36-50 | 51-57 | 58-89 | 90-100 | 101-110 | 1-30 | 31-35 | 36-49 | 50-66 | 67-98 | 99-102 | 103-113 |
| 1048 | 1-23 | 24-34 | 35-49 | 50-56 | 57-88 | 89-97 | 98-107 | 1-30 | 31-35 | 36-49 | 50-66 | 67-98 | 99-110 | 111-121 |
| 1056 | 1-23 | 24-34 | 35-49 | 50-56 | 57-88 | 89-97 | 98-107 | 1-30 | 31-35 | 36-49 | 50-66 | 67-98 | 99-110 | 111-121 |
| 1064 | 1-23 | 24-34 | 35-49 | 50-56 | 57-88 | 89-96 | 97-106 | 1-30 | 31-35 | 36-49 | 50-66 | 67-98 | 99-110 | 111-121 |
| 1080 | 1-22 | 23-35 | 36-50 | 51-57 | 58-89 | 90-100 | 101-110 | 1-30 | 31-35 | 36-49 | 50-66 | 67-98 | 99-102 | 103-113 |
| 1092 | 1-23 | 24-34 | 35-49 | 50-56 | 57-88 | 89-97 | 98-107 | 1-30 | 31-35 | 36-49 | 50-66 | 67-98 | 99-110 | 111-121 |
| 1094 | 1-22 | 23-35 | 36-50 | 51-57 | 58-89 | 90-100 | 101-110 | 1-30 | 31-35 | 36-49 | 50-66 | 67-98 | 99-102 | 103-113 |

TABLE 5-continued

Amino Acid Residue Positions** Corresponding to Framework and CDR Regions of anti-VEGF-A Antibodies

| Cluster # | Light FR1 range | Light CDR1 range | Light FR2 range | Light CDR2 range | Light FR3 range | Light CDR3 range | Light FR4 range | Heavy FR1 range | Heavy CDR1 range | Heavy FR2 range | Heavy CDR2 range | Heavy FR3 range | Heavy CDR3 range | Heavy FR4 range |
|---|---|---|---|---|---|---|---|---|---|---|---|---|---|---|
| 1096 | 1-23 | 24-34 | 35-49 | 50-56 | 57-88 | 89-97 | 98-107 | 1-30 | 31-35 | 36-49 | 50-66 | 67-98 | 99-110 | 111-121 |
| 1107 | 1-22 | 23-35 | 36-50 | 51-57 | 58-89 | 90-100 | 101-110 | 1-30 | 31-35 | 36-49 | 50-66 | 67-98 | 99-102 | 103-113 |
| 1111 | 1-23 | 24-34 | 35-49 | 50-56 | 57-88 | 89-97 | 98-107 | 1-30 | 31-35 | 36-49 | 50-66 | 67-98 | 99-111 | 112-122 |
| 1123 | 1-23 | 24-34 | 35-49 | 50-56 | 57-88 | 89-97 | 98-107 | 1-30 | 31-35 | 36-49 | 50-66 | 67-98 | 99-110 | 111-121 |
| 1135 | 1-23 | 24-34 | 35-49 | 50-56 | 57-88 | 89-97 | 98-107 | 1-30 | 31-35 | 36-49 | 50-66 | 67-98 | 99-102 | 103-113 |
| 1142 | 1-23 | 24-34 | 35-49 | 50-56 | 57-88 | 89-97 | 98-107 | 1-30 | 31-35 | 36-49 | 50-66 | 67-98 | 99-107 | 108-118 |
| 1155 | 1-22 | 23-35 | 36-50 | 51-57 | 58-89 | 90-100 | 101-110 | 1-30 | 31-35 | 36-49 | 50-66 | 67-98 | 99-102 | 103-113 |
| 1250 | 1-23 | 24-34 | 35-49 | 50-56 | 57-88 | 89-97 | 98-107 | 1-30 | 31-35 | 36-49 | 50-66 | 67-98 | 99-110 | 111-121 |
| 1252 | 1-23 | 24-34 | 35-49 | 50-56 | 57-88 | 89-97 | 98-107 | 1-30 | 31-35 | 36-49 | 50-66 | 67-98 | 99-107 | 108-118 |
| 1254 | 1-23 | 24-34 | 35-49 | 50-56 | 57-88 | 89-97 | 98-107 | 1-30 | 31-35 | 36-49 | 50-66 | 67-98 | 99-107 | 108-118 |
| 1257 | 1-22 | 23-35 | 36-50 | 51-57 | 58-89 | 90-106 | 107-116 | 1-30 | 31-35 | 36-49 | 50-66 | 67-98 | 99-107 | 108-118 |
| 1264 | 1-23 | 24-34 | 35-49 | 50-56 | 57-88 | 89-97 | 98-107 | 1-30 | 31-35 | 36-49 | 50-66 | 67-98 | 99-110 | 111-121 |
| 1266 | 1-23 | 24-34 | 35-49 | 50-56 | 57-88 | 89-97 | 98-107 | 1-30 | 31-35 | 36-49 | 50-66 | 67-98 | 99-110 | 111-121 |
| 1268 | 1-23 | 24-34 | 35-49 | 50-56 | 57-88 | 89-97 | 98-107 | 1-30 | 31-35 | 36-49 | 50-66 | 67-98 | 99-110 | 111-121 |
| 1269 | 1-23 | 24-34 | 35-49 | 50-56 | 57-88 | 89-97 | 98-107 | 1-30 | 31-35 | 36-49 | 50-66 | 67-98 | 99-110 | 111-121 |
| 1270 | 1-23 | 24-34 | 35-49 | 50-56 | 57-88 | 89-97 | 98-107 | 1-30 | 31-35 | 36-49 | 50-66 | 67-98 | 99-108 | 109-119 |
| 1281 | 1-23 | 24-34 | 35-49 | 50-56 | 57-88 | 89-97 | 98-107 | 1-30 | 31-35 | 36-49 | 50-66 | 67-98 | 99-107 | 108-118 |
| 1283 | 1-23 | 24-34 | 35-49 | 50-56 | 57-88 | 89-97 | 98-107 | 1-30 | 31-35 | 36-49 | 50-66 | 67-98 | 99-107 | 108-118 |
| 1285 | 1-23 | 24-34 | 35-49 | 50-56 | 57-88 | 89-97 | 98-107 | 1-30 | 31-35 | 36-49 | 50-66 | 67-98 | 99-107 | 108-118 |
| 1409 | 1-23 | 24-34 | 35-49 | 50-56 | 57-88 | 89-97 | 98-107 | 1-30 | 31-35 | 36-49 | 50-66 | 67-98 | 99-107 | 108-118 |
| 1410 | 1-23 | 24-34 | 35-49 | 50-56 | 57-88 | 89-97 | 98-107 | 1-30 | 31-35 | 36-49 | 50-66 | 67-98 | 99-102 | 103-113 |
| 1413 | 1-23 | 24-34 | 35-49 | 50-56 | 57-88 | 89-97 | 98-107 | 1-30 | 31-35 | 36-49 | 50-66 | 67-98 | 99-107 | 108-118 |
| 1416 | 1-23 | 24-34 | 35-49 | 50-56 | 57-88 | 89-97 | 98-107 | 1-30 | 31-35 | 36-49 | 50-66 | 67-98 | 99-107 | 108-118 |
| 1420 | 1-23 | 24-34 | 35-49 | 50-56 | 57-88 | 89-97 | 98-107 | 1-30 | 31-35 | 36-49 | 50-66 | 67-98 | 99-110 | 111-121 |
| 1428 | 1-23 | 24-34 | 35-49 | 50-56 | 57-88 | 89-97 | 98-107 | 1-30 | 31-35 | 36-49 | 50-66 | 67-98 | 99-107 | 108-116 |
| 1437 | 1-23 | 24-34 | 35-49 | 50-56 | 57-88 | 89-97 | 98-107 | 1-30 | 31-35 | 36-49 | 50-66 | 67-98 | 99-110 | 111-121 |
| 1449 | 1-23 | 24-34 | 35-49 | 50-56 | 57-88 | 89-97 | 98-107 | 1-30 | 31-35 | 36-49 | 50-66 | 67-98 | 99-102 | 103-113 |
| 1458 | 1-23 | 24-34 | 35-49 | 50-56 | 57-88 | 89-97 | 98-107 | 1-30 | 31-35 | 36-49 | 50-66 | 67-98 | 99-110 | 111-121 |
| 1476 | 1-23 | 24-34 | 35-49 | 50-56 | 57-88 | 89-97 | 98-107 | 1-30 | 31-35 | 36-49 | 50-66 | 67-98 | 99-107 | 108-118 |
| 1479 | 1-23 | 24-34 | 35-49 | 50-56 | 57-88 | 89-97 | 98-107 | 1-30 | 31-35 | 36-49 | 50-66 | 67-98 | 99-102 | 103-113 |

**Residue position numbers shown (indicated as a "range" of residue positions of either the variable light (VL) or variable heavy (VH) chain polypeptide) are according to VL or VH polypeptide sequences for the corresponding antibody cluster number, the amino acid SEQ ID NOs: for which are indicated in Table 4.

The anti-PDGFRβ and anti-VEGF-A antibodies listed in Tables 2-5 were grouped into families of consensus CDRs. Table 5 below shows consensus CDRs for anti-PDGFRβ and VEGF-A antibodies.

TABLE 6

Consensus CDRs for Anti-PDGFRβ and Anti-VEGF-A Antibodies

| CDR family/ Target Ag | LCDR1 | LCDR2 | LCDR3 |
|---|---|---|---|
| A/ PDGFRβ | KSSQSX$_1$LYSX$_2$NX$_3$KNYLA (X$_1$ is V or L; X$_2$ is S, A, or P; X$_3$ is N or K) (SEQ ID NO: 433) (X$_1$ is V; X$_2$ is S; X$_3$ is N) (SEQ ID NO: 443) | X$_1$ASTRES (X$_1$ is W or R) (SEQ ID NO: 434) | QQYYSX$_1$PX$_2$T (X$_1$ is T or I; X$_2$ is Y, F, W, or I) (SEQ ID NO: 435) (X$_1$ is T; X$_2$ is Y, W, or I) (SEQ ID NO: 444) |
| B/ VEGF-A | RX$_1$SX$_2$X$_3$IX$_4$X$_5$X$_6$X$_7$N (X$_1$ is A, T, or S; X$_2$ is Q or E; X$_3$ is S, G, T, or N; X$_4$ is S, D, R, or N; X$_5$ is S, T, R, G, or N; X$_6$ is Y or F; X$_7$ is L or V) (SEQ ID NO: 448) (X$_1$ is A or S; X$_2$ is Q; X$_3$ is S, T, or N; X$_4$ is S, D, or N; X$_5$ is S, T, or N; X$_6$ is Y or F; X$_7$ is L or V) (SEQ ID NO: 462) (X$_1$ is A; X$_2$ is Q; X$_3$ is S; X$_4$ is S, D; X$_5$ is S or T; X$_6$ is Y; X$_7$ is L) (SEQ ID NO: 463) | X$_1$X$_2$SX$_3$LX$_4$X$_5$ (X$_1$ is A, G, D, or T; X$_2$ is A or R; X$_3$ is S, T, K, N or R; X$_4$ is Q, E, K, or R; X$_5$ is S, D, or G) (SEQ ID NO: 449) (X$_1$ is A, D, or T; X$_2$ is A; X$_3$ is S, N or R; X$_4$ is Q, K, or R; X$_5$ is S or G) (SEQ ID NO: 464) (X$_1$ is A or T; | QQSYX$_1$X$_2$X$_3$X$_4$T (X$_1$ is T or S; X$_2$ is T, A, or S; X$_3$ is P or S; X$_4$ is L, Y, P, I, R, V, or F or is absent) (SEQ ID NO: 450) (X$_1$ is T or S; X$_2$ is T; X$_3$ is P or S; X$_4$ is L, Y, or F) (SEQ ID NO: 466) (X$_1$ is S; X$_2$ is T; X$_3$ is P; X$_4$ is L, Y, or F) (SEQ ID NO: 467) |

TABLE 6-continued

Consensus CDRs for Anti-PDGFRβ and Anti-VEGF-A Antibodies

| CDR family/ Target Ag | LCDR1 | LCDR2 | LCDR3 |
|---|---|---|---|
| | | $X_2$ is A; $X_3$ is S or N; $X_4$ is Q; $X_5$ is S) (SEQ ID NO: 465) | |
| C/VEGF-A | SG$X_1$SSNIG$X_2$N$X_3$V$X_4$ ($X_1$ is S or V; $X_2$ is K, S, R, or A; $X_3$ is A, T, P, N, S, Y, or I; $X_4$ is H, N, Q, T, or S) (SEQ ID NO: 462) ($X_1$ is S; $X_2$ is S or R; $X_3$ is T, P, N, or I; $X_4$ is N or Q) (SEQ ID NO: 471) ($X_1$ is S or V; $X_2$ is K, S, or R; $X_3$ is A, T, P, N, or S; $X_4$ is H, N, Q, or T) (SEQ ID NO: 472) ($X_1$ is S; $X_2$ is S or R; $X_3$ is T, P, or N; $X_4$ is N or Q) (SEQ ID NO: 473) | $X_1X_2X_3X_4X_5P$ $X_6$ ($X_1$ is Y, G, S, R, or T; $X_2$ is N or D; $X_3$ is N, R, or D; $X_4$ is L, Q, or R; $X_5$ is L or R; $X_6$ is P or S) (SEQ ID NO: 463) ($X_1$ is G or S; $X_2$ is N or D; $X_3$ is N, R, or D; $X_4$ is Q or R; $X_5$ is R; $X_6$ is P or S) (SEQ ID NO: 474) ($X_1$ is Y, G, S, or R; $X_2$ is N or D; $X_3$ is N or D; $X_4$ is L, Q, or R; $X_5$ is L or R; $X_6$ is P or S) (SEQ ID NO: 475) ($X_1$ is G or S; $X_2$ is N or D; $X_3$ is N or D; $X_4$ is Q or R; $X_5$ is R; $X_6$ is P or S) (SEQ ID NO: 476) ($X_1$ is Y, G, S, or R; $X_2$ is N or D; $X_3$ is N or D; $X_4$ is L, Q, or R; $X_5$ is L or R; $X_6$ is P) (SEQ ID NO: 479) | $X_1X_2$WDD$X_3$L$X_4$ $X_5X_6$V ($X_1$ is A or T; $X_2$ is A or T; $X_3$ is N or S; $X_4$ is N or S; $X_5$ is G or V; and $X_6$ is P, W, or V) (SEQ ID NO: 464) ($X_1$ is A; $X_2$ is A or T; $X_3$ is S; $X_4$ is N or S; $X_5$ is G or V; and $X_6$ is W or V) (SEQ ID NO: 480) |

| CDR family/ Target Ag | HCDR1 | HCDR2 | HCDR3 |
|---|---|---|---|
| A/ PDGFRβ | $X_1YX_2MX_3$ ($X_1$ is K, Q, R, M, G, or N; $X_2$ is K, M, V, F, I, S, R, or P; $X_3$ is L, Q, T, S, E, V, or G) (SEQ ID NO: 436) ($X_1$ is K, Q, R, or M; $X_2$ is K, M, V, or F; $X_3$ is L, Q, T, or S) (SEQ ID NO: 445) ($X_1$ is K; $X_2$ is K; $X_3$ is L or Q) (SEQ ID NO: 446) | $X_1IX_2$PSGG$X_3$T$X_4$YADSVKG ($X_1$ is S or G; $X_2$ is Y, S, or W; $X_3$ is V, I, L, or M; $X_4$ is F, T, or V) (SEQ ID NO: 437) ($X_1$ is S; $X_2$ is Y or S; $X_3$ is V or L; $X_4$ is F) (SEQ ID NO: 447) | DGIPLSIAAPIDY (SEQ ID NO: 438) DRPTGKTGYFQH (SEQ ID NO: 439) AYSSGWSLPFDY (SEQ ID NO: 440) ARRMRSLWEAFDI (SEQ ID NO: 441) DGEMISGSFFDS (SEQ ID NO: 442) |

TABLE 6-continued

Consensus CDRs for Anti-PDGFRβ and Anti-VEGF-A Antibodies

| | | | |
|---|---|---|---|
| B/ VEGF-A | $X_1YX_2MX_3$ ($X_1$ is K, G, R, H, or W; $X_2$ is D, I, or E; $X_3$ is H, W, E, G, V, D, or A) (SEQ ID NO: 451) ($X_1$ is K, G, H, or W; $X_2$ is D, I, or E; $X_3$ is H, W, E, V, or D) (SEQ ID NO: 468) ($X_1$ is W; $X_2$ is D; $X_3$ is V) (SEQ ID NO: 469) | $X_1ISX_2SGGX_3X_4X_5YADX_6VKG$ ($X_1$ is V, S, or Y; $X_2$ is P or S; $X_3$ is W or D; $X_4$ is T or A; $X_5$ is S, W, A, or T; $X_6$ is S or P) (SEQ ID NO: 452) ($X_1$ is V or Y; $X_2$ is P or S; $X_3$ is W or D; $X_4$ is T; $X_5$ is S, W, or A; $X_6$ is S) (SEQ ID NO: 470) ($X_1$ is V; $X_2$ is P; $X_3$ is W; $X_4$ is T; $X_5$ is S; $X_6$ is S) (SEQ ID NO: 538) | DHSGYDSEYFDY (SEQ ID NO: 453) DDYSKGRDAFDI (SEQ ID NO: 454) DSSGYYSPDAFDI (SEQ ID NO: 455) AGDY (SEQ ID NO: 456) ASSGDAFDI (SEQ ID NO: 457) ADSDYDSFDY (SEQ ID NO: 458) IGYADAFDI (SEQ ID NO: 459) IDYADAFDI (SEQ ID NO: 460) DGYSKGRDAFDI (SEQ ID NO: 461) |
| C/VEGF-A | $X_1YX_2MX_3$ ($X_1$ is D, G, or H; $X_2$ is L, I, or E; $X_3$ is V, W, or A) (SEQ ID NO: 465) ($X_1$ is D or G; $X_2$ is L or I; $X_3$ is V or W) (SEQ ID NO: 477) AAWDDS PTGDDSL SSYV (SEQ ID NO: 466) | $X_1ISPSGGX_2TX_3YADSVKG$ ($X_1$ is Y or V; $X_2$ is W or D; $X_3$ is A, W, or S) (SEQ ID NO: 467) ($X_1$ is Y or V; $X_2$ is W or D; $X_3$ is A or W) (SEQ ID NO: 478) | AGDY (SEQ ID NO: 468) VVELRAGDAFDI (SEQ ID NO: 469) EGPLDAFDI (SEQ ID NO: 470) |

In certain embodiments, an anti-PDGFRβ or anti-VEGF-A antibody of the present invention comprises one or more consensus CDRs as shown for CDR family A, B, or C in Table 6. For example, in certain embodiments, the antibody comprises a heavy chain consensus CDR (at least one of the HCDR1, HCDR2, and HCDR3 regions) and/or a corresponding light chain consensus CDR (at least one of the LCDR1, LCDR2, and LCDR3 regions) as shown for CDR family A, B, or C in Table 6. In typical embodiments, the anti-PDGFRβ antibody has two or three heavy chain consensus CDRs and/or two or three light chain consensus CDRs as shown for CDR family A, B, or C in Table 6. In certain embodiments, where an anti-PDGFRβ or anti-VEGF-A antibody has at least one heavy chain consensus CDR as shown for CDR family A, B, or C in Table 6, the antibody further comprises at least one light chain consensus CDR from the same CDR family.

In some embodiments, an anti-PDGFRβ or anti-VEGF-A antibody of the present invention comprises one or more CDRs of an anti-PDGFRβ or anti-VEGF-A antibody listed in Table 2 or Table 4 (boundaries of corresponding CDR regions shown in Tables 3 and 5, respectively). For example, in certain variations, the antibody comprises a heavy chain CDR (at least one of the HCDR1, HCDR2, and HCDR3 regions) and/or a corresponding light chain CDR (at least one of the LCDR1, LCDR2, and LCDR3 regions) of an antibody listed in Table 2 or Table 4. In typical embodiments, the anti-PDGFRβ or anti-VEGF-A antibody has two or three heavy chain CDRs and/or two or three light chain CDRs of an antibody listed in Table 2 or Table 4. In some variations, where an anti-PDGFRβ or anti-VEGF-A antibody has at least one heavy chain CDR an antibody listed in Table 2 or Table 4, the antibody further comprises at least one corresponding light chain CDR.

In certain typical embodiments, an anti-PDGFRβ or anti-VEGF-A antibody includes a heavy and/or light chain variable domain, the heavy or light chain variable domain having (a) a set of three CDRs corresponding to heavy or light chain consensus CDRs as shown for CDR family A, B, or C in Table 6, and (b) a set of four framework regions.

In particular variations, an anti-PDGFRβ or anti-VEGF-A antibody includes a heavy and/or light chain variable domain, the heavy or light chain variable domain having (a) a set of three CDRs corresponding to the heavy or light chain CDRs as shown for an antibody listed in Table 2 or Table 4, and (b) a set of four framework regions. For example, an anti-PDGFRβ or anti-VEGF-A antibody can include a heavy and/or light chain variable domain, where the heavy or light chain variable domain has (a) a set of three CDRs, in which the set of CDRs are from an antibody listed in Table 2 or Table 4, and (b) a set of four framework regions, in which the set of framework regions are identical to or different from the set of framework regions of the same antibody listed in Table 2 or Table 4.

In specific embodiments, an anti-PDGFRβ or anti-VEGF-A antibody includes a heavy chain variable region and/or light chain variable region that is substantially identical to the heavy and/or light chain variable region(s) of an antibody listed in Table 2 or Table 4.

Accordingly, in certain embodiments, an anti-PDGFRβ antibody has (a) a heavy chain variable domain that is at least 80%, at least 85%, at least 90%, at least 95%, at least 96%, at least 97%, at least 98%, at least 99%, or at least 99.5% identical to the amino acid sequence of a $V_H$ polypeptide listed in Table 2 and/or (b) a light chain variable domain that is at least 80%, at least 85%, at least 90%, at least 95%, at least 96%, at least 97%, at least 98%, at least 99%, or at least 99.5% identical to the amino acid sequence of a $V_L$ polypeptide listed in Table 2. In certain embodiments, the anti-PDGFRβ antibody includes (a) a heavy chain variable region having the amino acid sequence of a $V_H$ polypeptide listed in Table 2 and/or (b) a light chain variable region having the amino acid sequence of a $V_L$ polypeptide listed in Table 2. Typically, where an antibody comprises both a heavy chain variable domain and a light chain variable domain, the heavy and light chains correspond to the same reference antibody from Table 2. For example, in certain embodiments, an anti-PDGFRβ antibody comprises light and heavy chain variable domains having respective VL and VH amino acid sequences selected from the following $V_L/V_H$ sequence pairs: SEQ ID NOs: 6 and 8; SEQ ID NOs: 10 and 12; SEQ ID NOs: 14 and 16; SEQ ID NOs: 18 and 20; SEQ ID NOs: 22 and 24; SEQ ID NOs: 26 and 28; SEQ ID NOs: 30 and 32; SEQ ID NOs: 34 and 36; SEQ ID NOs: 38 and 40; SEQ ID NOs: 42 and 44; SEQ ID NOs: 46 and 48; SEQ ID NOs: 50 and 52; SEQ ID NOs: 54 and 56; SEQ ID NOs: 58 and 60; SEQ ID NOs: 62 and 64; SEQ ID NOs: 66 and 68; SEQ ID NOs: 70 and 72; SEQ ID NOs: 74 and 76; SEQ ID NOs: 78 and 80; SEQ ID NOs: 82 and 84; SEQ ID NOs: 86 and 88; SEQ ID NOs: 90 and 92; SEQ ID NOs: 94 and 96; SEQ ID NOs: 98 and 100; SEQ ID NOs: 102 and 104; SEQ ID NOs: 106 and 108; SEQ ID NOs: 110 and 112; SEQ ID NOs: 114 and 116; SEQ ID NOs: 118 and 120; SEQ ID NOs: 122 and 124; SEQ ID NOs: 126 and 128; SEQ ID NOs: 130 and 132; SEQ ID NOs: 134 and 136; SEQ ID NOs: 138 and 140; SEQ ID NOs: 142 and 144; SEQ ID NOs: 146 and 148; SEQ ID NOs: 150 and 152; SEQ ID NOs: 154 and 156; SEQ ID NOs: 158 and 160; and SEQ ID NOs: 162 and 164.

In other embodiments, an anti-VEGF-A antibody has (a) a heavy chain variable domain that is at least 80%, at least 85%, at least 90%, at least 95%, at least 96%, at least 97%, at least 98%, at least 99%, or at least 99.5% identical to the amino acid sequence of a $V_H$ polypeptide listed in Table 4 and/or (b) a light chain variable domain that is at least 80%, at least 85%, at least 90%, at least 95%, at least 96%, at least 97%, at least 98%, at least 99%, or at least 99.5% identical to the amino acid sequence of a $V_L$ polypeptide listed in Table 4. In certain embodiments, the anti-VEGF-A antibody includes (a) a heavy chain variable region having the amino acid sequence of a $V_H$ polypeptide listed in Table 4 and/or (b) a light chain variable region having the amino acid sequence of a $V_L$ polypeptide listed in Table 4. Typically, where an antibody comprises both a heavy chain variable domain and a light chain variable domain, the heavy and light chains correspond to the same reference antibody from Table 4. For example, in certain embodiments, an anti-VEGF-A antibody comprises light and heavy chain variable domains having respective $V_L$ and $V_H$ amino acid sequences selected from the following $V_L/V_H$ sequence pairs: SEQ ID NOs: 166 and 168; SEQ ID NOs: 170 and 172; SEQ ID NOs: 174 and 176; SEQ ID NOs: 178 and 180; SEQ ID NOs: 182 and 184; SEQ ID NOs: 186 and 188; SEQ ID NOs: 190 and 192; SEQ ID NOs: 194 and 196; SEQ ID NOs: 198 and 200; SEQ ID NOs: 202 and 204; SEQ ID NOs: 206 and 208; SEQ ID NOs: 210 and 212; SEQ ID NOs: 214 and 216; SEQ ID NOs: 218 and 220; SEQ ID NOs: 222 and 224; SEQ ID NOs: 226 and 228; SEQ ID NOs: 230 and 232; SEQ ID NOs: 234 and 236; SEQ ID NOs: 238 and 240; SEQ ID NOs: 242 and 244; SEQ ID NOs: 246 and 248; SEQ ID NOs: 250 and 252; SEQ ID NOs: 254 and 256; SEQ ID NOs: 258 and 260; SEQ ID NOs: 262 and 264; SEQ ID NOs: 266 and 268; SEQ ID NOs: 270 and 272; SEQ ID NOs: 274 and 276; SEQ ID NOs: 278 and 280; SEQ ID NOs: 282 and 284; SEQ ID NOs: 286 and 288; SEQ ID NOs: 290 and 292; SEQ ID NOs: 294 and 296; SEQ ID NOs: 298 and 300; SEQ ID NOs: 302 and 304; SEQ ID NOs: 306 and 308; SEQ ID NOs: 310 and 312; SEQ ID NOs: 314 and 316; SEQ ID NOs: 318 and 320; SEQ ID NOs: 322 and 324; SEQ ID NOs: 326 and 328; SEQ ID NOs: 330 and 332; SEQ ID NOs: 334 and 336; SEQ ID NOs: 338 and 340; SEQ ID NOs: 342 and 344; SEQ ID NOs: 346 and 348; SEQ ID NOs: 350 and 352; SEQ ID NOs: 354 and 356; SEQ ID NOs: 358 and 360; SEQ ID NOs: 362 and 364; SEQ ID NOs: 366 and 368; SEQ ID NOs: 370 and 372; SEQ ID NOs: 374 and 376; SEQ ID NOs: 378 and 380; SEQ ID NOs: 382 and 384; SEQ ID NOs: 386 and 388; SEQ ID NOs: 390 and 392; SEQ ID NOs: 394 and 396; SEQ ID NOs: 398 and 400; SEQ ID NOs: 402 and 404; SEQ ID NOs: 406 and 408; SEQ ID NOs: 410 and 412; SEQ ID NOs: 414 and 416; SEQ ID NOs: 418 and 420; SEQ ID NOs: 422 and 424; SEQ ID NOs: 426 and 428; and SEQ ID NOs: 430 and 432.

In some embodiments, an antibody in accordance with the present invention includes a heavy and/or light chain variable region comprising at least one CDR having zero, one, two, three, or four amino acid substitutions relative to a CDR of a $V_L$ or $V_H$ polypeptide as listed in Tables 2 or 4 (CDR amino acid ranges shown in Tables 3 and 5, respectively). In certain variations, for example, an anti-PDGFRβ antibody in accordance with the present invention comprises heavy chain CDRs HCDR1, HCDR2, and HCDR3, wherein at least one of HCDR1, HCDR2, and HCDR3 comprises zero, one, two, three, or four amino acid substitutions relative to a $V_H$ polypeptide listed in Table 2. In other variations, an anti-PDGFRβ antibody in accordance with the present invention comprises light chain CDRs LCDR1, LCDR2, and LCDR3, wherein at least one of LCDR1, LCDR2, and LCDR3 comprises zero, one, two, three, or four amino acid substitutions relative to a $V_L$ polypeptide listed in Table 2. In certain embodiments, an anti-PDGFRβ antibody comprises both sets of heavy chain and light chain CDRs as above. Particularly suitable anti-PDGFRβ antibodies comprise a light chain variable domain comprising CDRs LCDR1, LCDR2, and LCDR3 and a heavy chain variable domain comprising CDRs HCDR1, HCDR2, and HCDR3, wherein said set of heavy and light chain CDRs has 6 or fewer, typically five or fewer, more typically four or fewer, and most typically 3 or fewer amino acid substitutions relative to heavy and light chain CDRs of an antibody listed in Table 2.

In other variations, an anti-VEGF-A antibody in accordance with the present invention comprises heavy chain CDRs HCDR1, HCDR2, and HCDR3, wherein at least one of HCDR1, HCDR2, and HCDR3 comprises zero, one, two, three, or four amino acid substitutions relative to a $V_H$ polypeptide listed in Table 4. In other variations, an anti- VEGF-A antibody in accordance with the present invention comprises light chain CDRs LCDR1, LCDR2, and LCDR3, wherein at least one of LCDR1, LCDR2, and LCDR3 comprises zero, one, two, three, or four amino acid substitutions relative to a $V_L$ polypeptide listed in Table 4. In certain embodiments, an anti-VEGF-A antibody comprises both sets of heavy chain and light chain CDRs as above. Particularly suitable anti-VEGF-A antibodies comprise a light chain variable domain comprising CDRs LCDR1, LCDR2, and LCDR3 and a heavy chain variable domain comprising CDRs HCDR1, HCDR2, and HCDR3, wherein said set of heavy and light chain CDRs has 6 or fewer, typically five or fewer, more typically four or fewer, and most typically 3 or fewer amino acid substitutions relative to heavy and light chain CDRs of an antibody listed in Table 4.

In certain embodiments, an anti-PDGFRβ antibody in accordance with the present invention comprises a $V_L$ domain comprising CDRs LCDR1, LCDR2, and LCDR3 and a $V_H$ domain comprising CDRs HCDR1, HCDR2, and HCDR3, where LCDR1 has the amino acid sequence shown in SEQ ID NO: 433; LCDR2 has the amino acid sequence shown in SEQ ID NO: 434; LCDR3 has the amino acid sequence shown in SEQ ID NO: 435; HCDR1 has the amino acid sequence shown in SEQ ID NO: 436; HCDR2 has the amino acid sequence shown in SEQ ID NO: 437; and HCDR3 has an amino acid sequence selected from the group consisting of SEQ ID NOs: 438-442. In some such embodiments of an anti-PDGFRβ antibody, LCDR1 has the amino acid sequence shown in SEQ ID NO: 443; LCDR3 has the amino acid sequence shown in SEQ ID NO: 444; and HCDR1 has the amino acid sequence shown in SEQ ID NO: 445. For example, in some variations, LCDR1 has the amino acid sequence shown in SEQ ID NO: 443; LCDR2 has the amino acid sequence shown in SEQ ID NO: 434; LCDR3 has the amino acid sequence shown in SEQ ID NO: 444; HCDR1 has the amino acid sequence shown in SEQ ID NO: 446; HCDR2 has the amino acid sequence shown in SEQ ID NO: 447, and HCDR3 has an amino acid sequence as set forth SEQ ID NO: 441 or SEQ ID NO: 442. In other variations, LCDR1 has the amino acid sequence shown in SEQ ID NO: 443; LCDR2 has the amino acid sequence shown in SEQ ID NO: 434; LCDR3 has the amino acid sequence shown in SEQ ID NO: 444; and HCDR1, HCDR2, and HCDR3 have the heavy chain CDR sequences of an antibody having selected from the group consisting of c597, 975, c600, c941, c949, and c1035.

In other embodiments of an anti-PDGFRβ antibody, LCDR1 has the amino acid sequence shown in SEQ ID NO: 433; LCDR2 has the LCDR2 amino acid sequence of an antibody selected from the group consisting of c597 and c600 (residues 56-62 of SEQ ID NO: 6 or 10); LCDR3 has the LCDR3 amino acid sequence of an antibody selected from the group consisting of c597, c600, and c1035 (residues 95-103 of SEQ ID NO: 6, 10, or 46); HCDR1 has the HCDR1 amino acid sequence of antibody selected from the group consisting of c597, c600, c941, c949, and c1035 (residues 31-35 of SEQ ID NO: 8, 12, 24, 36, or 48); HCDR2 has the HCDR2 amino acid sequence of an antibody selected from the group consisting of c597, c600, c941, c949, and c1035 (residues 50-66 of SEQ ID NO: 8, 12, 24, 36, or 48); and HCDR3 has an amino acid sequence selected from the group consisting of SEQ ID NOs: 438-442. In some such embodiments, LCDR2, LCDR3, HCDR1, HCDR2, and HCDR3 have the LCDR2, LCDR3, HCDR1, HCDR2, and HCDR3 amino acid sequences of an antibody selected from the group consisting of c597, c600, c941, c949, c975, and c1035. In specific variations, the antibody comprises the $V_L$ and $V_H$ domains of an antibody selected from the group consisting of c597, c600, c941, c949, c975, and c1035.

In other embodiments, an anti-PDGFRβ antibody in accordance with the present invention comprises a $V_L$ domain comprising CDRs LCDR1, LCDR2, and LCDR3 and a $V_H$ domain comprising CDRs HCDR1, HCDR2, and HCDR3, wherein said set of $V_L$ and $V_H$ CDRs has 3 or fewer amino acid substitutions relative to a second set of CDRs, where said second set of CDRs has the LCDR1, LCDR2, LCDR3, HCDR1, HCDR2, and HCDR3 amino acid sequences of an antibody selected from group consisting of c597, c600, c941, c949, c975, and c1035. In particular variations, the antibody comprises zero, one, or two amino acid substitutions in said set of CDRs.

In still other embodiments, an anti-PDGFRβ antibody in accordance with the present invention comprises a $V_L$ domain comprising CDRs LCDR1, LCDR2, and LCDR3 and a $V_H$ domain comprising CDRs HCDR1, HCDR2, and HCDR3, wherein said set of $V_L$ and $V_H$ CDRs has 3 or fewer amino acid substitutions relative to a second set of CDRs in which LCDR1, LCDR2, LCDR3, HCDR1, HCDR2, and HCDR3 amino acid sequences of the antibody having the cluster designation c613. In particular variations, the antibody comprises zero, one, or two amino acid substitutions in said set of CDRs. In some embodiments, the antibody comprises the CDRs of antibody c613. For example, in a specific variation, the antibody comprises the $V_L$ and $V_H$ domains of antibody c613 (i.e., the $V_L$ domain comprises an amino acid sequence as shown in SEQ ID NO: 18 and the $V_H$ domain comprises an amino acid sequence as shown in SEQ ID NO: 20).

In certain embodiments, an anti-VEGF-A antibody in accordance with the present invention comprises a $V_L$ domain comprising CDRs LCDR1, LCDR2, and LCDR3 and a $V_H$ domain comprising CDRs HCDR1, HCDR2, and HCDR3, where LCDR1 has the amino acid sequence shown in SEQ ID NO: 448; LCDR2 has the amino acid sequence shown in SEQ ID NO: 449; LCDR3 has the amino acid sequence shown in SEQ ID NO: 450; HCDR1 has the amino acid sequence shown in SEQ ID NO: 451; HCDR2 has the amino acid sequence shown in SEQ ID NO: 452; and HCDR3 has an amino acid sequence selected from the group consisting of SEQ ID NOs: 453-461. In some such embodiments of a VEGF-A antibody, LCDR1 has the amino acid sequence shown in SEQ ID NO: 462; LCDR2 has the amino acid sequence shown in SEQ ID NO: 464; LCDR3 has the amino acid sequence shown in SEQ ID NO: 466; HCDR1 has the amino acid sequence shown in SEQ ID NO: 468; HCDR2 has the amino acid sequence shown in SEQ ID NO: 470; and HCDR3 has an amino acid sequence selected from the group consisting of SEQ ID NOs: 453-459. In specific variations of such an anti-VEGF-A antibody, LCDR1 and LCDR2 have the LCDR1 and LCDR2 amino acid sequence of an antibody selected from the group consisting of c636, c868, c1039, c1092, c1111, c1135, c1270, c1410, and c1476 (the amino acid sequences shown, respectively, in residues 24-34 and residues 50-56 of SEQ ID NO: 170, SEQ ID NO: 242, SEQ ID NO: 278, SEQ ID NO: 306, SEQ ID NO: 322, SEQ ID NO: 330, SEQ ID NO: 374, SEQ ID NO: 394, or SEQ ID NO: 426). In some such variations, HCDR1 has the HCDR1 amino acid sequence of an antibody selected from the group consisting of c636, c868, c1039, c1092, and c1111 (residues 31-35 of SEQ ID NO: 172, 244, 280, 308, or 324); in particular embodiments in which HCDR1 has the HCDR1 amino acid sequence of antibody c1039, HCDR2 optionally has the HCDR2 amino acid sequence of an antibody selected from the group consisting of c1039, c1270, and c1476 (residues 50-66 of SEQ ID NO: 280, 376, or 428).

In some embodiments of an anti-VEGF-A antibody in accordance with the present invention, LCDR1 has the amino acid sequence shown in SEQ ID NO: 463; LCDR2 has the amino acid sequence shown in SEQ ID NO: 465; LCDR3 has the amino acid sequence shown in SEQ ID NO: 467; HCDR1 has the HCDR1 amino acid sequence of antibody c1039 (residues 31-35 of SEQ ID NO: 280); HCDR2 has the HCDR2 amino acid sequence of antibody c1039 (residues 50-66 of SEQ ID NO: 280); and HCDR3 has an amino acid sequence selected from the group consisting of SEQ ID NOs: 453-461. In some such embodiments, HCDR3 has an amino acid sequence selected from the group consisting of SEQ ID NOs: 453, 458, and 459.

In other embodiments of an anti-VEGF-A antibody in accordance with the present invention, LCDR1 has the LCDR1 amino acid sequence of an antibody selected from the group consisting of c636, c1135, c1410, and c1476 (residues 24-34 of SEQ ID NO: 170, 330, 394, or 426); LCDR2 has the LCDR2 amino acid sequence of an antibody selected from the group consisting of c636, c868, c1111, c1135, c1410, and c1476 (residues 50-56 of SEQ ID NO: 170, 242, 322, 330, 394, or 426); LCDR3 has the LCDR3 amino acid sequence of an antibody selected from the group consisting of c636, c868, c1039, c1410, and c1476 (residues 89-97 of SEQ ID NO: 170, 242, 278, 394, or 426); HCDR1 has the HCDR1 amino acid sequence of an antibody selected from the group consisting of c636, c868, c1039, c1092, and c1111 (residues 31-35 of SEQ ID NO: 172, 244, 280, 308, or 324); HCDR2 has the HCDR2 amino acid sequence of an antibody selected from the group consisting of c636, c868, c1039, and c1111 (residues 50-66 of SEQ ID NO: 172, 244, 280, or 324); and HCDR3 has an amino acid sequence selected from the group consisting of SEQ ID NOs: 453-461. In specific variations, the anti-VEGF-A antibody has CDRs LCDR1, LCDR2, LCDR3, HCDR1, HCDR2, and HCDR3 of an antibody selected from the group consisting of c636, c868, c1039 CDRs; c1092; c1111; c1135; c1270; c1410; and c1476. For example, in particular embodiments, the anti-VEGF-A antibody has the light and heavy chain variable domains ($V_L$ and $V_H$) of an antibody selected from the group consisting of c636, c868, c1039 CDRs; c1092; c1111; c1135; c1270; c1410; and c1476.

In other embodiments, an anti-VEGF-A antibody in accordance with the present invention comprises a $V_L$ domain comprising CDRs LCDR1, LCDR2, and LCDR3 and a $V_H$ domain comprising CDRs HCDR1, HCDR2, and HCDR3, wherein said set of $V_L$ and $V_H$ CDRs has 3 or fewer amino acid substitutions relative to a second set of CDRs, where said second set of CDRs has the LCDR1, LCDR2, LCDR3, HCDR1, HCDR2, and HCDR3 amino acid sequences of an antibody selected from group consisting of c636, c868, c1039 CDRs; c1092; c1135; c1270; c1410; and c1476. In particular variations, the antibody comprises zero, one, or two amino acid substitutions in said set of CDRs.

In some embodiments, an anti-VEGF-A antibody in accordance with the present invention comprises a $V_L$ domain comprising CDRs LCDR1, LCDR2, and LCDR3 and a $V_H$ domain comprising CDRs HCDR1, HCDR2, and HCDR3, where LCDR1 has the amino acid sequence shown in SEQ ID NO: 462; LCDR2 has the amino acid sequence shown in SEQ ID NO: 463; LCDR3 has an amino acid sequence selected from the group consisting of SEQ ID NOs: 464 and 465; HCDR1 has the amino acid sequence shown in SEQ ID NO: 466; HCDR2 has the amino acid sequence shown in SEQ ID NO: 467; and HCDR3 has an amino acid sequence selected from the group consisting of SEQ ID NOs: 468-470. In some such embodiments, LCDR1 has the amino acid sequence shown in SEQ ID NO: 471; LCDR2 has the amino acid sequence shown in SEQ ID NO: 474; HCDR1 has the amino acid sequence shown in SEQ ID NO: 477; HCDR2 has the amino acid sequence shown in SEQ ID NO: 478; and HCDR3 has an amino acid sequence selected from the group consisting of SEQ ID NOs: 468 and 469.

In other such embodiments of an anti-VEGF-A antibody, LCDR1 has an amino acid sequence shown in SEQ ID NO: 472; LCDR2 has the amino acid sequence shown in SEQ ID NO: 475; HCDR1 has the amino acid sequence shown in SEQ ID NO: 477; HCDR2 has the amino acid sequence shown in SEQ ID NO: 478; and HCDR3 has an amino acid sequence selected from the group consisting of SEQ ID NOs: 468 and 469. In particular variations, HCDR1, HCDR2, and HCDR3 have the HCDR1, HCDR2, and HCDR3 amino acid sequences of antibody c870 (shown respectively in residues 31-35, residues 50-66, and residues 99-102 of SEQ ID NO: 248). In some such variations, LCDR2 has the amino acid sequence shown in SEQ ID NO: 479 and LCDR3 has the amino acid sequence shown in SEQ ID NO: 480.

In other embodiments of an anti-VEGF-A antibody in accordance with the present invention, LCDR1 has the LCDR1 amino acid sequence of an antibody selected from the group consisting of c752, c870, c1036, c1044, c1094, c1155, and c1257 (residues 23-35 of SEQ ID NO: 214, 246, 274, 286, 310, 338, or 354); LCDR2 has the LCDR2 amino acid sequence of an antibody selected from the group consisting of c752, c870, c1036, c1044, c1094, c1155, and c1257 (residues 51-57 of SEQ ID NO: 214, 246, 274, 286, 310, 338, or 354); LCDR3 has the LCDR3 amino acid sequence of an antibody selected from the group consisting of c752, c870, c1036, c1044, c1094, c1155, and c1257 (residues 90-100 of SEQ ID NO: 214, 246, 274, 286, 310, or 338); HCDR1 has the HCDR1 amino acid sequence of an antibody selected from the group consisting of c752, c870, and c1257 (residues 31-35 of SEQ ID NO: 216, 248, or 356); and HCDR2 has the HCDR2 amino acid sequence of an antibody selected from the group consisting of c752, c870, and c1257 (residues 50-66 of SEQ ID NO: 216, 248, or 356). In specific variations, the anti-VEGF-A antibody has CDRs LCDR1, LCDR2, LCDR3, HCDR1, HCDR2, and HCDR3 of an antibody selected from the group consisting of c752, c870, c1036, c1044, c1094, c1155, and c1257. For example, in particular embodiments, the anti-VEGF-A antibody has the light and heavy chain variable domains ($V_L$ and $V_H$) of an antibody selected from the group consisting of c752, c870, c1036, c1044, c1094, c1155, and c1257.

In yet other embodiments, an anti-VEGF-A antibody in accordance with the present invention comprises a $V_L$ domain comprising CDRs LCDR1, LCDR2, and LCDR3 and a $V_H$ domain comprising CDRs HCDR1, HCDR2, and HCDR3, wherein said set of $V_L$ and $V_H$ CDRs has 3 or fewer amino acid substitutions relative to a second set of CDRs, where said second set of CDRs has the LCDR1, LCDR2, LCDR3, HCDR1, HCDR2, and HCDR3 amino acid sequences of an antibody selected from group consisting of c752, c870, c1036, c1044, c1094, c1155, and c1257. In particular variations, the antibody comprises zero, one, or two amino acid substitutions in said set of CDRs.

Epitopes recognized by anti-PDGFRβ antibodies of the present invention typically include five or more amino acids of the extracellular domain of human PDGFRβ (residues 33-531 of SEQ ID NO: 4). Preferred epitopes comprise at least one amino acid included within one or more of the following polypeptide regions of PDGFRβ: LVVTLHEK-KGDVALPVPYDH (residues 156-175 of SEQ ID NO: 4); DREVDSDAYY (amino acid residues 196-205 of SEQ ID NO: 4); KTTIGDREVDSDAYYVYRLQ (residues 191-210 of SEQ ID NO: 4); ITLMCIVIGNEVVNFEWTYP (residues 231-250 of SEQ ID NO: 4); and RKESGRLVEPVTD-FLLDMPY (residues 251-270 of SEQ ID NO: 4). In certain embodiments, the epitope comprises at least two, at least three, at least four, at least five, at least six, or at least seven amino acids from one or more of the PDGFRβ polypeptide regions as shown in residues 196-205 and 251-270 of SEQ ID NO: 4. In some variations, such PDGFRβ epitopes are epitopes as determined by peptide microarray epitope mapping comprising the use of overlapping PDGFRβ peptides (e.g., 20-mer peptides, with, for example, 5 amino acid shifts between each pair of sequential peptides).

In some related variations, an anti-PDGFRβ antibody in accordance with the present invention binds to an epitope comprising one or more amino acids included within a first polypeptide region of PDGFRβ as shown in amino acid residues 251-270 of SEQ ID NO: 4. Exemplary anti-PDGFRβ antibodies having this epitope specificity include antibodies comprising light and heavy chain variable domains having respective $V_L$ and $V_H$ amino acid sequences selected from the following $V_L/V_H$ sequence pairs: SEQ ID NOs: 6 and 8; SEQ ID NOs: 10 and 12; SEQ ID NOs: 22 and 24; and SEQ ID NOs: 46 and 48. In certain embodiments, the epitope further comprises one or more amino acids included within a second polypeptide region of PDGFRβ as shown in amino acid residues 196-205 or 191-210 of SEQ ID NO: 4. Exemplary anti-PDGFRβ antibodies of this class include antibodies comprising light and heavy chain variable domains having respective $V_L$ and $V_H$ amino acid sequences selected from the following $V_L/V_H$ sequence pairs: SEQ ID NOs: 22 and 24; and SEQ ID NOs: 46 and 48.

In other, related embodiments, an anti-PDGFRβ antibody in accordance with the present invention is capable of specifically binding to an immobilized, PDGFRβ-derived peptide corresponding to one or more of the PDGFRβ polypeptide regions specified above. Typically, the anti-PDGFRβ antibody is capable of binding to such a PDGFRβ-derived peptide in which any amino acid corresponding to a cysteine residue in SEQ ID NO: 4 is substituted with serine. In some embodiments, the PDGFRβ-derived peptide consists of 10, 15, 20, 22, 25, 27, or 30 contiguous amino acids of SEQ ID NO: 4, wherein any amino acid corresponding to a cysteine residue is substituted with serine.

In certain variations, an anti-PDGFRβ antibody is capable of binding to a PDGFRβ-derived peptide comprising an amino acid sequence selected from the following: DREVDSDAYY (SEQ ID NO: 583); RKESGRLVEPVTD-FLLDMPY (SEQ ID NO: 569); LVVTLHEKKGD-VALPVPYDH (SEQ ID NO: 649); and ITLMCIVIGNEV-VNFEWTYP (SEQ ID NO: 650). In specific variations of an anti-PDGFRβ antibody capable of binding to a PDGFRβ-derived peptide comprising the amino acid sequence DREVDSDAYY, the PDGFRβ-derived peptide comprises an amino acid sequence selected from the following: RSY-ISKTTIGDREVDSDAYY (SEQ ID NO: 566); KTTIG-DREVDSDAYYVYRLQ (SEQ ID NO: 567); and DREVDSDAYYVYRLQVSSIN (SEQ ID NO: 568). In particular variations, the PDGFRβ-derived peptide consists of an amino acid sequence selected from SEQ ID NOs: 566, 567, 568, 569, 649, and 650.

In related variations, an anti-PDGFRβ antibody in accordance with the present invention is capable of binding to a first immobilized peptide consisting the amino acid sequence shown in SEQ ID NO: 569. Exemplary anti-PDGFRβ antibodies having this epitope specificity include antibodies comprising light and heavy chain variable domains having respective $V_L$ and $V_H$ amino acid sequences selected from the following $V_L/V_H$ sequence pairs: SEQ ID NOs: 6 and 8; SEQ ID NOs: 10 and 12; SEQ ID NOs: 22 and 24; and SEQ ID NOs: 46 and 48. In certain embodiments, such an anti-PDGFRβ antibody is further capable of binding to a second immobilized peptide consisting of the amino acid sequence shown in SEQ ID NO: 566, 567, or 568. Exemplary anti-PDGFRβ antibodies of this class include antibodies comprising light and heavy chain variable domains having respective $V_L$ and $V_H$ amino acid sequences selected from the following $V_L/V_H$ sequence pairs: SEQ ID NOs: 22 and 24; and SEQ ID NOs: 46 and 48.

Epitopes recognized by anti-VEGF-A antibodies of the present invention typically include five or more amino acids of human VEGF-$A_{165}$ (residues 27-191 of SEQ ID NO: 2). Preferred epitopes comprise at least one amino acid included within one or more of the following polypeptide regions of VEGF-A: HEVVKFMDVYQRSYCHPIETL (amino acid residues 38-58 of SEQ ID NO: 2), EYIFKPSCVPLMRCG (amino acid residues 70-84 of SEQ ID NO: 2), EESNIT-MQIMRIKPHQG (amino acid residues 98-114 of SEQ ID NO: 2), and PCGPCSERRKHLF (amino acid residues 142-154). In certain embodiments, the epitope comprises at least two, at least three, at least four, at least five, at least six, or at least seven amino acids from one or more of the VEGF-A polypeptide regions as shown in residues 38-58, 70-84, 98-114, and 142-154 of SEQ ID NO: 2. In some variations, such VEGF-A epitopes are epitopes as determined by peptide microarray epitope mapping comprising the use of overlapping VEGF-A peptides (e.g., 13-mer peptides, with, for example, 2 amino acid shifts between each pair of sequential peptides).

In particular variations of an anti-VEGF-A antibody as above, the anti-VEGF-A epitope comprises at least one amino acid included within one or more of the following polypeptide regions of VEGF-A: KFMDVYQRSYC (amino acid residues 42-52 of SEQ ID NO: 2), IFKPSCVPLMR (amino acid residues 72-82 of SEQ ID NO: 2), IMRIK-PHQG (amino acid residues 106-114 of SEQ ID NO: 2), and PCGPCSERRKHLF (amino acid residues 142-154). In certain embodiments, the epitope comprises at least two, at least three, at least four, at least five, at least six, or at least seven amino acids from one or more of the VEGF-A polypeptide regions as shown in residues 42-52, 72-82, 106-114, and 142-154 of SEQ ID NO: 2.

In some related variations, an anti-VEGF-A antibody in accordance with the present invention binds to an epitope comprising (a) one or more amino acids included within a first polypeptide region of VEGF-A as shown in amino acid residues 38-58 or 42-52 of SEQ ID NO: 2 and (b) one or more amino acids included within a second polypeptide region of VEGF-A as shown in amino acid residues 70-84 or 72-82 of SEQ ID NO: 2. Exemplary anti-VEGF-A antibodies having this epitope specificity include antibodies comprising light and heavy chain variable domains having respective $V_L$ and $V_H$ amino acid sequences selected from the following. $V_L/V_H$ sequence pairs: SEQ ID NOs: 170 and 172; SEQ ID NOs: 242 and 244; SEQ ID NOs: 246 and 248; and SEQ ID NOs: 278 and 280.

In certain embodiments of an anti-VEGF-A antibody binding to an epitope comprising (a) and (b) as above, the epitope does not comprise an amino acid included within a polypeptide region of VEGF-A as shown in residues 90 to 132 of SEQ ID NO: 2 (EGLECVPTEESNITMQIMRIK-PHQGQHIGEMSFLQHNKCECRP). An exemplary anti-VEGF-A antibody of this class comprises light and heavy chain variable domains having the amino acid sequences as shown in SEQ ID NOs: 246 and 248, respectively.

In other embodiments of an anti-VEGF-A antibody binding to an epitope comprising (a) and (b) as above, the epitope further comprises (c) one or more amino acids included within a third polypeptide region of VEGF-A as shown in residues 96-114 or 106-114 of SEQ ID NO: 2. Exemplary anti-VEGF-A antibodies of this class include antibodies comprising light and heavy chain variable domains having respective $V_L$ and $V_H$ amino acid sequences selected from the following $V_L/V_H$ sequence pairs: SEQ ID NOs: 170 and 172; SEQ ID NOs: 242 and 244; and SEQ ID NOs: 278 and 280.

In some embodiments of an anti-VEGF-A antibody binding to an epitope comprising (a), (b), and (c) as above, the antibody does not bind to human and mouse VEGF-A with $K_d$ values within 10-fold of the other. Exemplary anti-VEGF-A antibodies of this class include antibodies comprising light and heavy chain variable domains having respective $V_L$ and $V_H$ amino acid sequences selected from the following $V_L/V_H$ sequence pairs: SEQ ID NOs: 242 and 244; and SEQ ID NOs: 278 and 280.

In yet other variations of an anti-VEGF-A antibody binding to an epitope comprising (a) and (b) as above, the epitope further comprises (d) one or more amino acids included within a fourth polypeptide region of VEGF-A as shown in residues 142-154 of SEQ ID NO: 2. Exemplary anti-VEGF-A antibodies of this class include antibodies comprising light and heavy chain variable domains having respective $V_L$ and $V_H$ amino acid sequences selected from the following $V_L/V_H$ sequence pairs: SEQ ID NOs: 242 and 244; and SEQ ID NOs: 278 and 280.

In other, related embodiments, an anti-VEGF-A antibody in accordance with the present invention is capable of specifically binding to an immobilized, VEGF-A-derived peptide corresponding to one or more of the VEGF-A polypeptide regions specified above. Typically, the anti-VEGF-A antibody is capable of binding to such a VEGF-A-derived peptide in which any amino acid corresponding to a cysteine residue in SEQ ID NO: 2 is substituted with serine. In some embodiments, the VEGF-A-derived peptide consists of 10, 11, 13, 15, 17, 20, or 25 contiguous amino acids of SEQ ID NO: 2, wherein any amino acid corresponding to a cysteine residue is substituted with serine. In particular variations, an anti-VEGF-A antibody is capable of binding to a VEGF-A-derived peptide comprising an amino acid sequence selected from the following: KFMDVYQRS (SEQ ID NO: 579), IFKPSSVPLMR (SEQ ID NO: 580), IMRIKPHQG (SEQ ID NO: 581), and GPSSERRKHLF (SEQ ID NO: 582). In some such variations, the VEGF-A derived peptide is a peptide consisting of an amino acid sequence selected from the group consisting of HEVVKF-MDVYQRS (SEQ ID NO: 544), VVKFMDVYQRSYS (SEQ ID NO: 545), KFMDVYQRSYSHP (SEQ ID NO: 546), EYIFKPSSVPLMR (SEQ ID NO: 552), IFKPSSV-PLMRSG (SEQ ID NO: 553), ITMQIMRIKPHQG (SEQ ID NO: 558), IMRIKPHQGQHIG (SEQ ID NO: 559), and PSGPSSERRKHLF (SEQ ID NO: 560).

In other variations, an anti-VEGF-A antibody is capable of binding to a VEGF-A-derived peptide selected from those set forth in Table 33, infra.

In related variations, an anti-VEGF-A antibody in accordance with the present invention is capable of binding to (a) an first immobilized, VEGF-A-derived peptide consisting of 13 amino acids and comprising the amino acid sequence shown in SEQ ID NO: 579; and (b) a second immobilized, VEGF-A-derived peptide consisting of 13 amino acids and comprising the amino acid sequence shown in SEQ ID NO: 580. Exemplary anti-VEGF-A antibodies having this epitope specificity include antibodies comprising light and heavy chain variable domains having respective $V_L$ and $V_H$ amino acid sequences selected from the following $V_L/V_H$ sequence pairs: SEQ ID NOs: 170 and 172; SEQ ID NOs: 242 and 244; SEQ ID NOs: 246 and 248; and SEQ ID NOs: 278 and 280.

In certain embodiments of an anti-VEGF-A antibody binding to first and second peptides as above, the anti-VEGF-A antibody does not bind to a peptide (e.g., a peptide consisting of 13 amino acids) derived from a region of VEGF-A included within amino acid residues 90 to 132 of SEQ ID NO: 2. An exemplary anti-VEGF-A antibody of this class comprises light and heavy chain variable domains having the amino acid sequences as shown in SEQ ID NOs: 246 and 248, respectively.

In yet other embodiments of an anti-VEGF-A antibody binding to first and second peptides as above, the antibody is further capable of binding to a third, immobilized, VEGF-A-derived peptide consisting of 13 amino acids and comprising the amino acid sequence shown in SEQ ID NO: 581. In some such embodiments, the antibody does not bind to human and mouse VEGF-A with $K_d$ values within 10-fold of the other. Exemplary anti-VEGF-A antibodies of this class include antibodies comprising light and heavy chain variable domains having respective $V_L$ and $V_H$ amino acid sequences selected from the following $V_L/V_H$ sequence pairs: SEQ ID NOs: 242 and 244; and SEQ ID NOs: 278 and 280.

In certain embodiments, an anti-PDGFRβ or anti-VEGF-A antibody is an antibody fragment such as, for example, an Fv, Fab, Fab', F(ab)$_2$, F(ab')$_2$, scFv, or diabody. In some preferred embodiments, an anti-PDGFRβ or anti-VEGF-A antibody is an scFv. scFv entities that bind PDGFRβ or VEGF-A can be oriented with the variable light ($V_L$) region either amino terminal to the variable heavy ($V_H$) region or carboxylterminal to it. In some variations, an anti-PDGFRβ scFv has the CDRs of an anti-PDGFRβ antibody listed in Table 2 and/or an anti-VEGF-A scFv has the CDRs of an anti-VEGF-A antibody listed in Table 4. In particular variations, an anti-PDGFRβ scFv has the $V_L$ and $V_H$ domains of an anti-PDGFRβ antibody listed in Table 2 and/or an anti-VEGF-A scFv has the $V_L$ and $V_H$ domains of an anti-VEGF-A antibody listed in Table 4. In certain embodiments, the CDRs or the $V_L$ and $V_H$ domains of an anti-PDGFRβ scFv are those of an anti-PDGFRβ antibody selected from c597, c600, c941, c949, c975, c1035, and c613. In other embodiments, the CDRs or the $V_L$ and $V_H$ domains of an anti-VEGF-A scFv are those of an anti-VEGF-A antibody selected from c636, c868, c1039, c1092, c1111, c1135, c1270, c1410, c1476, c1155, c752, c870, c1036, c1094, c1044, and c1257. In specific variations of an anti-VEGF-A scFv, the scFv comprises an amino acid sequence as set forth in SEQ ID NO: 498 (c1111.1 scFv; nucleotide sequence shown in SEQ ID NO: 497); SEQ ID NO: 500 (c870.1 scFv; nucleotide sequence shown in SEQ ID NO: 499); SEQ ID NO: 502 (c1092.1 scFv; nucleotide sequence shown in SEQ ID NO: 501); SEQ ID NO: 504 (c1039.1 scFv; nucleotide sequence shown in SEQ ID NO: 503); SEQ ID NO: 506 (c868.1 scFv; nucleotide sequence shown in SEQ ID NO: 505); or SEQ ID NO: 508 (c1081.1 scFv; nucleotide sequence shown in SEQ ID NO: 507). Additionally, scFvs may be provided in any of a variety of bispecific antibody formats such as, for example, tandem scFv (tascFv), bi-single chain Fv (biscFv), and whole monoclonal antibody with a single chain Fv (scFv) fused to the carboxyl terminus (biAb) (see infra).

In certain aspects, an anti-PDGFRβ or anti-VEGF-A antibody as described herein is provided as a bispecific binding composition. As used herein, the term "bispecific binding composition" refers to a composition capable of specifically binding to at least two different target molecules via at least two binding entities having different binding specificities. The binding entities may be, for example, a protein (e.g., antibody or soluble receptor) or small molecule. The binding entities of a bispecific binding composition may be or may not be physically linked.

In certain embodiments, a bispecific binding composition of the invention neutralizes both PDGFRβ and a biological activity of a second target molecule and comprises an anti-PDGFRβ antibody as described herein. In other embodiments, a bispecific binding composition of the invention neutralizes both VEGF-A and a biological activity of a second target molecule and comprises an anti-VEGF-A antibody as described herein. Preferred bispecific binding compositions in accordance with the present invention are those capable of neutralizing both PDGFRβ and VEGF-A. Accordingly, in particular variations, a bispecific binding composition comprises an anti-PDGFRβ antibody as described herein and a second binding entity capable of neutralizing the activity of VEGF-A. In other variations, a bispecific binding composition comprises an anti-VEGF-A antibody as described herein and a second binding entity capable of neutralizing the activity of PDGFRβ. Particularly preferred bispecific binding compositions in accordance with the present invention comprise a both an anti-PDGFRβ antibody as described herein and an anti-VEGF-A antibody as described herein.

In certain embodiments, two or more different entities of a bispecific binding composition are linked via linker to form a multimer (e.g., a dimer). For example, in the case of a bispecific binding composition comprising a fusion of at least two polypeptide components (e.g., an anti-PDGFRβ antibody and another polypeptide component; or an anti-VEGF-A antibody and another polypeptide component), a peptide linker sequence may be employed to separate, for example, the polypeptide components by a distance sufficient to ensure that each polypeptide folds into its secondary and tertiary structures. Fusion proteins may generally be prepared using standard techniques, including chemical conjugation. Fusion proteins can also be expressed as recombinant proteins in an expression system by standard techniques. Suitable linkers are further described herein, infra.

A linker can be naturally-occurring, synthetic, or a combination of both. For example, a synthetic linker can be a randomized linker, e.g., both in sequence and size. In one aspect, the randomized linker can comprise a fully randomized sequence, or optionally, the randomized linker can be based on natural linker sequences. The linker can comprise, for example, a non-polypeptide moiety (e.g., a polynucleotide), a polypeptide, or the like.

A linker can be rigid, or alternatively, flexible, or a combination of both. Linker flexibility can be a function of the composition of both the linker and the subunits that the linker interacts with. The linker joins two selected binding entities (e.g., two separate polypeptides or proteins, such as two different antibodies) and maintains the entities as separate and discrete. The linker can allow the separate, discrete domains to cooperate yet maintain separate properties such as multiple separate binding sites for the same target in a multimer or, for example, multiple separate binding sites for different targets in a multimer. In some cases, a disulfide bridge exists between two linked binding entities or between a linker and a binding entity.

Choosing a suitable linker for a specific case where two or more binding entities are to be connected may depend on a variety of parameters including, e.g., the nature of the binding entities, the structure and nature of the target to which the bispecific composition should bind, and/or the stability of the linker (e.g., peptide linker) towards proteolysis and oxidation.

Particularly suitable linker polypeptides predominantly include amino acid residues selected from Glycine (Gly), Serine (Ser), Alanine (Ala), and Threonine (Thr). For example, the peptide linker may contain at least 75% (calculated on the basis of the total number of residues present in the peptide linker), such as at least 80%, at least 85%, or at least 90% of amino acid residues selected from Gly, Ser, Ala, and Thr. The peptide linker may also consist of Gly, Ser, Ala and/or Thr residues only. The linker polypeptide should have a length that is adequate to link two binding entities in such a way that they assume the correct conformation relative to one another so that they retain the desired activity, such as binding to a target molecule as well as other activities that may be associated with such target binding (e.g., agonistic or antagonistic activity for a given biomolecule).

A suitable length for this purpose is, e.g., a length of at least one and typically fewer than about 50 amino acid residues, such as 2-25 amino acid residues, 5-20 amino acid residues, 5-15 amino acid residues, 8-12 amino acid residues or 11 residues. Other suitable polypeptide linker sizes may include, e.g., from about 2 to about 15 amino acids, from about 3 to about 15, from about 4 to about 12, about 10, about 8, or about 6 amino acids. The amino acid residues selected for inclusion in the linker polypeptide should exhibit properties that do not interfere significantly with the activity or function of the polypeptide multimer. Thus, the peptide linker should, on the whole, not exhibit a charge that would be inconsistent with the activity or function of the multimer, or interfere with internal folding, or form bonds or other interactions with amino acid residues in one or more of the domains that would seriously impede the binding of the multimer to the target in question.

The use of naturally occurring as well as artificial peptide linkers to connect polypeptides into novel linked fusion polypeptides is well-known in the art. (See, e.g., Hallewell et al, *J. Biol. Chem.* 264, 5260-5268, 1989; Alfthan et al., *Protein Eng.* 8, 725-731, 1995; Robinson and Sauer, *Biochemistry* 35, 109-116, 1996; Khandekar et al., *J. Biol. Chem.* 272, 32190-32197, 1997; Fares et al., *Endocrinology* 139, 2459-2464, 1998; Smallshaw et al., *Protein Eng.* 12, 623-630, 1999; U.S. Pat. No. 5,856,456.)

One example where the use of peptide linkers is widespread is for production of single-chain antibodies where the variable regions of a light chain ($V_L$) and a heavy chain ($V_H$) are joined through an artificial linker, and a large number of publications exist within this particular field. A widely used peptide linker is a 15mer consisting of three repeats of a Gly-Gly-Gly-Gly-Ser amino acid sequence (($Gly_4Ser)_3$) (SEQ ID NO: 539). Other linkers have been used, and phage display technology, as well as selective infective phage technology, has been used to diversify and select appropriate linker sequences (Tang et al., *J. Biol. Chem.* 271, 15682-15686, 1996; Hennecke et al., *Protein Eng.* 11, 405-410, 1998). Peptide linkers have been used to connect individual chains in hetero- and homo-dimeric proteins such as the T-cell receptor, the lambda Cro repressor, the P22 phage Arc repressor, IL-12, TSH, FSH, IL-5, and interferon-γ. Peptide linkers have also been used to create fusion polypeptides. Various linkers have been used, and, in the case of the Arc repressor, phage display has been used to optimize the linker length and composition for increased stability of the single-chain protein (see Robinson and Sauer, *Proc. Natl. Acad. Sci. USA* 95, 5929-5934, 1998).

Still another way of obtaining a suitable linker is by optimizing a simple linker (e.g., $(Gly_4Ser)_n$) through random mutagenesis.

As discussed above, it is generally preferred that the peptide linker possess at least some flexibility. Accordingly, in some variations, the peptide linker contains 1-25 glycine residues, 5-20 glycine residues, 5-15 glycine residues, or 8-12 glycine residues. Particularly suitable peptide linkers typically contain at least 50% glycine residues, such as at least 75% glycine residues. In some embodiments, a peptide linker comprises glycine residues only.

In certain variations, the peptide linker comprises other residues in addition to the glycine. Preferred residues in addition to glycine include Ser, Ala, and Thr, particularly Ser. One example of a specific peptide linker includes a peptide linker having the amino acid sequence $Gly_x$-Xaa-$Gly_y$-Xaa-$Gly_z$ (SEQ ID NO: 540), wherein each Xaa is independently selected from Alanine (Ala), Valine (Val), Leucine (Leu), Isoleucine (Ile), Methionine (Met), Phenylalanine (Phe), Tryptophan (Trp), Proline (Pro), Glycine (Gly), Serine (Ser), Threonine (Thr), Cysteine (Cys), Tyrosine (Tyr), Asparagine (Asn), Glutamine (Gln), Lysine (Lys), Arginine (Arg), Histidine (His), Aspartate (Asp), and Glutamate (Glu), and wherein x, y, and z are each integers in the range from 1-5. In some embodiments, each Xaa is independently selected from the group consisting of Ser, Ala, and Thr. In a specific variation, each of x, y, and z is equal to 3 (thereby yielding a peptide linker having the amino acid sequence Gly-Gly-Gly-Xaa-Gly-Gly-Gly-Xaa-Gly-Gly-Gly (SEQ ID NO: 541), wherein each Xaa is selected as above).

In some cases, it may be desirable or necessary to provide some rigidity into the peptide linker: This may be accomplished by including proline residues in the amino acid sequence of the peptide linker. Thus, in another embodiment, a peptide linker comprises at least one proline residue in the amino acid sequence of the peptide linker. For example, a peptide linker can have an amino acid sequence wherein at least 25% (e.g., at least 50% or at least 75%) of the amino acid residues are proline residues. In one particular embodiment of the invention, the peptide linker comprises proline residues only.

In some embodiments, a peptide linker is modified in such a way that an amino acid residue comprising an attachment group for a non-polypeptide moiety is introduced. Examples of such amino acid residues may be a cysteine or a lysine residue (to which the non-polypeptide moiety is then subsequently attached). Another alternative is to include an amino acid sequence having an in vivo N-glycosylation site (thereby attaching a sugar moiety (in vivo) to the peptide linker). An additional option is to genetically incorporate non-natural amino acids using evolved tRNAs and tRNA synthetases (see, e.g., U.S. Patent Application Publication 2003/0082575) into a polypeptide binding entity or peptide linker. For example, insertion of keto-tyrosine allows for site-specific coupling to an expressed polypeptide.

In certain variations, a peptide linker comprises at least one cysteine residue, such as one cysteine residue. For example, in some embodiments, a peptide linker comprises at least one cysteine residue and amino acid residues selected from the group consisting of Gly, Ser, Ala, and Thr.

In some such embodiments, a peptide linker comprises glycine residues and cysteine residues, such as glycine residues and cysteine residues only. Typically, only one cysteine residue will be included per peptide linker'. One example of a specific peptide linker comprising a cysteine residue includes a peptide linker having the amino acid sequence $Gly_n$-Cys-$Gly_m$, (SEQ ID NO: 542), wherein n and m are each integers from 1-12, e.g., from 3-9, from 4-8, or from 4-7. In a specific variation, such a peptide linker has the amino acid sequence GGGGG-C-GGGGG (SEQ ID NO: 543).

As previously noted, in certain embodiments, a bispecific binding composition comprises an anti-PDGFRβ antibody and an anti-VEGF-A antibody. In some such embodiments, the anti-PDGFRβ and anti-VEGF-A antibodies are covalently linked (e.g., via a peptide linker) to form a bispecific antibody. In some variations, the bispecific antibody comprises an immunoglobulin heavy chain constant region such as, for example, an Fc fragment. Particularly suitable Fc fragments include, for example, Fc fragments comprising an Fc region modified to reduce or eliminate one or more effector functions (e.g., Fc5, having the amino acid sequence shown in SEQ ID NO: 492).

For example, in some embodiments, a bispecific antibody that neutralizes both PDGFRβ and VEGF-A in accordance with the present invention comprises an antigen-binding region of an anti-PDGFRβ antibody as described herein and an antigen-binding region of an anti-VEGF-A antibody as described herein. In certain embodiments, a bispecific antibody comprises a first antigen-binding region having anti-PDGFRβ CDRs of consensus family A as listed in Table 6 and a second antigen-binding region having anti-VEGF-A CDRs of consensus family B or C as listed in Table 6. In other embodiments, a bispecific antibody comprises a first antigen-binding region having the CDRs of an anti-PDGFRβ antibody listed in Table 2 and a second antigen-binding region having the CDRs of an anti-VEGF-A antibody listed in Table 4: In particular variations, a bispecific antibody comprises a first antigen-binding region having the $V_L$ and $V_H$ domains of an anti-PDGFRβ antibody listed in Table 2 and a second antigen-binding region having the $V_L$ and $V_H$ domains of an anti-VEGF-A antibody listed in Table 4. In specific variations, the CDRs or the $V_L$ and $V_H$ domains of the first antigen-binding region are those of an anti-PDGFRβ antibody selected from c597, c600, c941, c949, c975, c1035, and c613; and the CDRs or the $V_L$ and $V_H$ domains of the second antigen-binding region are those of an anti-VEGF-A antibody selected from c636, c868, c1039, c1092, c1111, c1135, c1270, c1410, c1476, c1155, c752, c870, c1036, c1094, c1044, and c1257. In certain preferred embodiments, a bispecific antibody in accordance with the present invention is a tandem single chain Fv (tascFv), bi-single chain Fv (biscFv), or a whole monoclonal antibody with a single chain Fv (scFv) fused to the carboxyl terminus (biAb).

For the tascFv molecule, two scFv molecules are constructed such that one scFv is amino terminal to the other one in a tandem configuration. This can be done in each orientation. Tandem scFv molecules can be prepared with a linker between the scFv entities. In some embodiments, the linker is a Gly-Ser linker comprising a series of glycine and serine residues, and optionally including additional amino acids. In other embodiments, the linker is a lambda stump, kappa stump, or a CHI stump, each of which are derived from the native sequence just after the V region in the Fab. The tascFv can be further constructed as fusion protein to contain a Fc component ("tascFv Fc"). In some such embodiments, such an Fc fragment comprises an Fc region modified to reduce or eliminate one or more effector functions (e.g., Fc5, having the amino acid sequence shown in SEQ ID NO: 492).

The biscFv molecule is not a tandem configuration. Rather, it has a scFv at the N terminus and another at the C terminus of an Fc ("biscFv Fc"). These molecules can be made with the N terminal scFv directly fused to the Fc hinge and with either a short or a long linker at the C terminus connecting to the second scFv. These linkers are typically Gly-Ser linkers. In some embodiments, the Fc fragment comprises an Fc region modified to reduce or eliminate one or more effector functions (e.g., Fc5, having the amino acid sequence shown in SEQ ID NO: 492). In certain variations, a biscFv in accordance with the present invention comprises an N-terminal anti-PDGFRβ scFv and a C-terminal anti-VEGF-A scFv. In particular variations, the anti-PDGFRβ scFv comprises an amino acid sequence selected from the group consisting of SEQ ID NO: 603 (c941.1 scFv) and SEQ ID NO: 605 (c1035.1 scFv); and the anti-VEGF-A scFv comprises an amino acid sequence selected from the group consisting of SEQ ID NO: 608 (c868.1 scFv), SEQ ID NO: 610 (c870.1 scFv), and SEQ ID NO: 12 (c1039.1 scFv). In some specific variations, a biscFv in accordance with the present invention has an amino acid sequence selected from the group consisting of residues 20-770 of SEQ ID NO: 618 (c941.1-c868.1 biscFv); residues 20-768 of SEQ ID NO: 620 (c941.1-c870.1 biscFv); residues 20-773 of SEQ ID NO: 622 (c941.1-c1039.1 biscFv); residues 20-770 of SEQ ID NO: 624 (c1035.1-c868.1 biscFv); residues 20-768 of SEQ ID NO: 626 (c1035.1-c870.1 biscFv); and residues 20-773 of SEQ ID NO: 628 (c1035.1-c1039.1 biscFv). A biscFv as above may further include a secretory signal sequence such as shown, for example, in residues 1-19 of SEQ ID NO: 614, residues 1-19 of SEQ ID NO: 616, or residues 1-19 of SEQ ID NO: 618.

The biAb molecule is also not a tandem format. It comprises a whole monoclonal antibody with a scFv fused to the C terminus of the heavy chain. These molecules can be made, for example, by converting one scFv back to a light chain (kappa or lambda) and a gamma1 heavy chain with the second scFv connected by either a short or long Gly-Ser linker. These molecules can be made with a whole anti-PDGFRβ monoclonal antibody fused to an anti-VEGF-A scFv or, alternatively, with a whole anti-VEGF-A monoclonal antibody fused to an anti-PDGFRβ scFv. In some particular embodiments, a biAb in accordance with the present invention comprises a whole anti-PDGFRβ monoclonal antibody (IgG1) with the C-terminal end of the heavy chain fused to an anti-VEGF-A scFv comprising an amino acid sequence selected from the group consisting of SEQ ID NO: 498 (c1111.1 scFv), SEQ ID NO: 500 (c870.1 scFv), SEQ ID NO: 502 (c1092.1 scFv), SEQ ID NO: 504 (c1039.1 scFv), SEQ ID NO: 506 (c868.1 scFv), SEQ ID NO: 508 (c1081.1 scFv), SEQ ID NO: 607 (c868.1 scFv), SEQ ID NO: 609 (c870.1 scFv), or SEQ ID NO: 611 (c1039.1 scFv). In some such variations, the anti-PDGFRβ antibody has the $V_L$ and $V_H$ domains of anti-PDGFRβ antibody c597 (SEQ ID NOs: 6 and 8, respectively). In some specific variations, a biAb in accordance with the present invention comprises a first polypeptide having the amino acid sequence shown in residues 20-239 of SEQ ID NO: 537 or SEQ ID NO: 614 (c597.1 or c600.1 light chain) and a second polypeptide having an amino acid sequence selected from the group consisting of residues 20-734 of SEQ ID NO: 512 (c597.1 IgG1 heavy chain with C-terminal fusion to c1111.1 scFv); residues 20-727 of SEQ ID NO: 514 (c597.1 IgG1 heavy chain with C-terminal fusion to c870.1 scFv); residues 20-733 of SEQ ID NO: 516 (c597.1 IgG1 heavy chain with C-terminal fusion to c1092.1 scFv); residues 20-733 of SEQ ID NO: 518 (c597.1 IgG1 heavy chain with C-terminal fusion to c1039.1 scFv); residues 20-730 of SEQ ID NO: 20 (c597.1 IgG1 heavy chain with C-terminal fusion to c868.1 scFv); residues 20-731 of SEQ ID NO: 22 (c597.1 IgG1 heavy chain with C-terminal fusion to c1081.1 scFv); residues 20-729 of SEQ ID NO: 630 (c597.1 IgG1.1 heavy chain with C-terminal fusion to c868.1 scFv); residues 20-727 of SEQ ID NO: 632 (c597.1 IgG1.1 heavy chain with C-terminal fusion to c870.1 scFv); residues 20-732 of SEQ ID NO: 634 (c597.1 IgG1.1 heavy chain with C-terminal fusion to c1039.1 scFv); residues 20:729 of SEQ ID NO: 636 (c600.1 IgG1.1 heavy chain with C-terminal fusion to c868.1 scFv); residues 20-727 of SEQ ID NO: 638 (c600.1 IgG1.1 heavy chain with C-terminal fusion to c870.1 scFv); and residues 20-732 of SEQ ID NO: 640 (c600.1 IgG1.1 heavy chain with C-terminal fusion to c1039.1 scFv). A first and/or second biAb polypeptide as above may further include a secretory signal sequence such as shown, for example, in residues 1-19 of SEQ ID NO: 614, residues 1-19 of SEQ ID NO: 616, or residues 1-19 of SEQ ID NO: 618.

III. Nucleic Acids, Host Cells, and Methods for Producing Antibodies

The invention also includes nucleic acids encoding the heavy chain and/or light chain of the antibodies of the invention. Nucleic acids of the invention include nucleic acids having a region that is substantially identical to a $V_L$- and/or $V_H$-encoding polynucleotide as listed in Table 2 or 4, supra. In certain embodiments, a nucleic acid in accordance with the present invention has at least 80%, typically at least about 90%, and more typically at least about 95% or at least about 98% identity to a $V_L$- and/or $V_H$-encoding polynucleotide as listed in Table 2 or 4. Nucleic acids of the invention also include complementary nucleic acids. In some instances, the sequences will be fully complementary (no mismatches) when aligned. In other instances, there may be up to about a 20% mismatch in the sequences. In some embodiments of the invention are provided nucleic acids encoding both a heavy chain and a light chain of an antibody of the invention. The nucleic acid sequences provided herein can be exploited using codon optimization, degenerate sequence, silent mutations, and other DNA techniques to optimize expression in a particular host, and the present invention encompasses such sequence modifications.

Thus, in some aspects, the present invention provides one or more polynucleotide(s) (e.g., DNA or RNA) that encode an anti-PDGFRβ and/or anti-VEGF-A antibody as described herein. In some embodiments, a polynucleotide of the present invention encodes an anti-PDGFRβ antibody, such as, for example, an anti-PDGFRβ scFv. In other embodiments, a polynucleotide encodes an anti-VEGF-A antibody such as, for example, an anti-VEGF-A scFv. In some variations, a polynucleotide of the present invention encodes a bispecific antibody that binds and neutralizes both PDGFRβ and VEGF-A. In particular variations, the encoded bispecific antibody is a tascFv, biscFv, or biAb. Those skilled in the art will readily recognize that, in view of the degeneracy of the genetic code, considerable sequence variation is possible among these polynucleotide molecules.

Polynucleotide molecules comprising a polynucleotide sequence provided herein are propagated by placing the molecule in a vector. Viral and non-viral vectors are used, including plasmids. The choice of plasmid will depend on the type of cell in which propagation is desired and the purpose of propagation. Certain vectors are useful for amplifying and making large amounts of the desired DNA sequence. Other vectors are suitable for expression in cells in culture. Still other vectors are suitable for transfer and expression in cells in a whole animal or person. The choice of appropriate vector is well within the skill of the art. Many such vectors are available commercially. The partial or full-length polynucleotide is inserted into a vector typically by means of DNA ligase attachment to a cleaved restriction enzyme site in the vector. Alternatively, the desired nucleotide sequence can be inserted by homologous recombination in vivo. Typically this is accomplished by attaching regions of homology to the vector on the flanks of the desired nucleotide sequence. Regions of homology are added by ligation of oligonucleotides, or by polymerase chain reaction using primers comprising both the region of homology and a portion of the desired nucleotide sequence, for example.

For expression, an expression cassette or system may be employed. To express a nucleic acid encoding a polypeptide disclosed herein, a nucleic acid molecule encoding the polypeptide, operably linked to regulatory sequences that control transcriptional expression in an expression vector, is introduced into a host cell. In addition to transcriptional regulatory sequences, such as promoters and enhancers, expression vectors can include translational regulatory sequences and a marker gene which is suitable for selection of cells that carry the expression vector. The gene product encoded by a polynucleotide of the invention is expressed in any convenient expression system, including, for example, bacterial, yeast, insect, amphibian and mammalian systems. Suitable vectors and host cells are described, e.g., in U.S. Pat. No. 5,654,173. In the expression vector, the polypeptide-encoding polynucleotide is linked to a regulatory sequence as appropriate to obtain the desired expression properties. These can include promoters, enhancers, terminators, operators, repressors, and inducers. The promoters can be regulated (e.g., the promoter from the steroid inducible pIND vector (Invitrogen)) or constitutive (e.g., promoters from CMV, SV40, Elongation Factor, or LTR sequences). In some situations it may be desirable to use conditionally active promoters, such as tissue-specific or developmental stage-specific promoters. These are linked to the desired nucleotide sequence using the techniques described above for linkage to vectors. Any techniques known in the art can be used. Accordingly, the expression vector will generally provide a transcriptional and translational initiation region, which may be inducible or constitutive, where the coding region is operably linked under the transcriptional control of the transcriptional initiation region, and a transcriptional and translational termination region.

An expression cassette ("expression unit") may be introduced into a variety of vectors, e.g., plasmid, BAC, YAC, bacteriophage such as lambda, P1, M13, etc., plant or animal viral vectors (e.g., retroviral-based vectors, adenovirus vectors), and the like, where the vectors are normally characterized by the ability to provide selection of cells comprising the expression vectors. The vectors may provide for extrachromosomal maintenance, particularly as plasmids or viruses, or for integration into the host chromosome. Where extrachromosomal maintenance is desired, an origin sequence is provided for the replication of the plasmid, which may be low- or high copy-number. A wide variety of markers are available for selection, particularly those which protect against toxins, more particularly against antibiotics. The particular marker that is chosen is selected in accordance with the nature of the host, where in some cases, complementation may be employed with auxotrophic hosts.

Introduction of the DNA construct may use any convenient method, including, e.g., conjugation, bacterial transformation, calcium-precipitated DNA, electroporation, fusion, transfection, infection with viral vectors, biolistics, and the like.

Accordingly, proteins for use within the present invention can be produced in genetically engineered host cells according to conventional techniques. Suitable host cells are those cell types that can be transformed or transfected with exogenous DNA and grown in culture, and include bacteria, fungal cells, and cultured higher eukaryotic cells (including cultured cells of multicellular organisms), particularly cultured mammalian cells. Techniques for manipulating cloned DNA molecules and introducing exogenous DNA into a variety of host cells are disclosed by Sambrook et al., *Molecular Cloning: A Laboratory Manual* (2nd ed., Cold Spring Harbor Laboratory Press, Cold Spring Harbor, N.Y., 1989), and Ausubel et al., supra.

For example, for recombinant expression of an anti-VEGF-A and/or anti-PDGFRβ antibody, an expression vector may encode a heavy and/or light chain thereof, or a heavy and/or light chain variable domain, operably linked to a promoter. An expression vector may include, for example, the nucleotide sequence encoding the constant region(s) of the antibody molecule (see, e.g., PCT Publication WO 86/05807; PCT Publication WO 89/01036; and U.S. Pat. No. 5,122,464), and the variable domain(s) of the antibody may be cloned into such a vector for expression of the entire heavy and/or light chain. The expression vector is transferred to a host cell by conventional techniques, and the transfected cells are then cultured by conventional techniques to produce the anti-VEGF-A and/or anti-PDGFRβ antibody. In certain embodiments for the expression of double-chained antibodies, the heavy and light chains are co-expressed from separate vectors in the host cell for expression of the entire immunoglobulin molecule. In other embodiments for the expression of double-chained antibodies, the heavy and light chains are co-expressed from separate expression units in the same vector in the host cell for expression of the entire immunoglobulin molecule.

In certain variations, a bispecific antibody against both VEGF-A and PDGFRβ is expressed. In some such variations, where the antigen binding sites for both an anti-VEGF-A antibody and an anti-PDGFRβ antibody are present on a single polypeptide chain (such as, e.g., in the case of a tascFv or biscFv), an expression vector includes an expression unit comprising a transcription promoter, a nucleic acid segment encoding the polypeptide chain, and a transcription terminator, all in operable configuration. In specific embodiments for expression of a biscFv, the polypeptide encoded by the nucleic acid segment comprises an amino acid selected from the group consisting of residues 20-770 of SEQ ID NO: 618 (c941.1-c868.1 biscFv); residues 20-768 of SEQ ID NO: 620 (c941.1-c870.1 biscFv); residues 20-773 of SEQ ID NO: 622 (c941.1-c1039.1 biscFv); residues 20-770 of SEQ ID NO: 624 (c1035.1-c868.1 biscFv); residues 20-768 of SEQ ID NO: 626 (c1035.1-c870.1 biscFv); and residues 20-773 of SEQ ID NO: 628 (c1035.1-c1039.1 biscFv).

In other variations, where the bispecific antibody includes at least two different polypeptide chains to form a molecule having both anti-VEGF-A and anti-PDGFRβ antigen binding sites (such as, e.g., in the case of a biAb), separate expression units, each capable of expressing one of the polypeptide chains, may be used. For co-expression within a host cell, such separate expression units may be present on separate expression vectors or, alternatively, a single vector.

For example, in some embodiments for expression of a biAb comprising (i) an immunoglobulin light chain and (ii) an immunoglobulin γ heavy chain with an scFv fused at the carboxyl-terminus (IgG-scFv fusion), an expression vector includes first and second expression units, wherein the first expression unit comprises, in operable combination, a first transcription promoter, a first DNA segment encoding the immunoglobulin light chain, and a first transcription terminator; and wherein the second expression unit comprises, in operable combination, a second transcription promoter, a second DNA segment encoding the IgG-scFv fusion, and a second transcription terminator. In some alternative embodiments for expression of a biAb as above, the first and second expression units are present on separate expression vectors. The DNA segments encoding the immunoglobulin light chain and IgG-scFv fusion, whether on the same vector or separate vectors, may be co-expressed within a host cell to produce the biAb. In some specific embodiments for expression of a biAb, the first DNA segment encodes an immunoglobulin light chain comprising the amino acid sequence as shown in residues 20-239 of SEQ ID NO: 537, and the second DNA segment encodes an IgG-scFv fusion comprising an amino acid sequence selected from the group consisting of amino acid residues 20-729 of SEQ ID NO: 630, amino acid residues 20-732 of SEQ ID NO: 634, amino acid residues 20-729 of SEQ ID NO: 636, and amino acid residues 20-732 of SEQ ID NO: 640. In other specific embodiments for expression of a biAb, the first DNA segment encodes an immunoglobulin light chain comprising the amino acid sequence as shown in residues 20-239 of SEQ ID NO: 537, and the second DNA segment encodes an IgG-scFv fusion comprising an amino acid sequence selected from the group consisting of amino acid residues 20-727 of SEQ ID NO: 632 and amino acid residues 20-727 of SEQ ID NO: 638.

To direct a recombinant protein into the secretory pathway of a host cell, a secretory signal sequence (also known as a leader sequence, prepro sequence or pre sequence) is provided in the expression vector. The secretory signal sequence may be that of the native form of the recombinant protein, or may be derived from another secreted protein (e.g., t-PA; see U.S. Pat. No. 5,641,655) or synthesized de novo. The secretory signal sequence is operably linked to the protein-encoding DNA sequence, i.e., the two sequences are joined in the correct reading frame and positioned to direct the newly synthesized polypeptide into the secretory pathway of the host cell. Secretory signal sequences are commonly positioned 5' to the DNA sequence encoding the polypeptide of interest, although certain signal sequences may be positioned elsewhere in the DNA sequence of interest (see, e.g., Welch et al., U.S. Pat. No. 5,037,743; Holland et al., U.S. Pat. No. 5,143,830). In particular variations, a secretory signal sequence for use in accordance with the present invention has an amino acid sequence selected from the group consisting of residues 1-19 of SEQ ID NO: 614, residues 1-19 of SEQ ID NO: 616, and residues 1-19 of SEQ ID NO: 618; exemplary nucleotide sequences coding for these amino acid sequences are shown, respectively, in residues 1-57 of SEQ ID NO: 613, residues 1-57 of SEQ ID NO: 615, and residues 1-57 of SEQ ID NO: 617.

Cultured mammalian cells are suitable hosts for production of recombinant proteins for use within the present invention. Methods for introducing exogenous DNA into mammalian host cells include calcium phosphate-mediated transfection (Wigler et al., *Cell* 14:725, 1978; Corsaro and Pearson, *Somatic Cell Genetics* 7:603, 1981: Graham and Van der Eb, *Virology* 52:456, 1973), electroporation (Neumann et al., *EMBO J.* 1:841-845, 1982), DEAE-dextran mediated transfection (Ausubel et al., supra), and liposome-mediated transfection (Hawley-Nelson et al., *Focus* 15:73, 1993; Ciccarone et al., *Focus* 15:80, 1993). The production of recombinant polypeptides in cultured mammalian cells is disclosed by, for example, Levinson et al., U.S. Pat. No. 4,713,339; Hagen et al., U.S. Pat. No. 4,784,950; Palmiter et al., U.S. Pat. No. 4,579,821; and Ringold, U.S. Pat. No. 4,656,134. Examples of suitable mammalian host cells include African green monkey kidney cells (Vero; ATCC CRL 1587), human embryonic kidney cells (293-HEK; ATCC CRL 1573), baby hamster kidney cells (BHK-21, BHK-570; ATCC CRL 8544, ATCC CRL 10314), canine kidney cells (MDCK; ATCC CCL 34), Chinese hamster ovary cells (CHO-K1; ATCC CCL61; CHO DG44; CHO DXB11 (Hyclone, Logan, Utah); see also, e.g., Chasin et al., *Som. Cell. Molec. Genet.* 12:555, 1986)), rat pituitary cells (GH1; ATCC CCL82), HeLa S3 cells (ATCC CCL2.2), rat hepatoma cells (H-4-II-E; ATCC CRL 1548) SV40-transformed monkey kidney cells (COS-1; ATCC CRL 1650) and murine embryonic cells (NIH-3T3; ATCC CRL 1658). Additional suitable cell lines are known in the art and available from public depositories such as the American Type Culture Collection, Manassas, Va. Strong transcription promoters can be used, such as promoters from SV-40 or cytomegalovirus. See, e.g., U.S. Pat. No. 4,956,288. Other suitable promoters include those from metallothionein genes (U.S. Pat. Nos. 4,579,821 and 4,601,978) and the adenovirus major late promoter.

Drug selection is generally used to select for cultured mammalian cells into which foreign DNA has been inserted. Such cells are commonly referred to as "transfectants." Cells that have been cultured in the presence of the selective agent and are able to pass the gene of interest to their progeny are referred to as "stable transfectants." Exemplary selectable markers include a gene encoding resistance to the antibiotic neomycin, which allows selection to be carried out in the presence of a neomycin-type drug, such as G-418 or the like; the gpt gene for xanthine-guanine phosphoribosyl transferase, which permits host cell growth in the presence of mycophenolic acid/xanthine; and markers that provide resistance to zeocin, bleomycin, blastocidin, and hygromycin (see, e.g., Gatignol et al., *Mol. Gen. Genet.* 207:342, 1987; Drocourt et al., *Nucl. Acids Res.* 18:4009, 1990). Selection systems can also be used to increase the expression level of the gene of interest, a process referred to as "amplification." Amplification is carried out by culturing transfectants in the presence of a low level of the selective agent and then increasing the amount of selective agent to select for cells that produce high levels of the products of the introduced genes. An exemplary amplifiable selectable marker is dihydrofolate reductase, which confers resistance to methotrexate. Other drug resistance genes (e.g., hygromycin resistance, multi-drug resistance, puromycin acetyltransferase) can also be used.

Other higher eukaryotic cells can also be used as hosts, including insect cells, plant cells and avian cells. The use of *Agrobacterium rhizogenes* as a vector for expressing genes in plant cells has been reviewed by Sinkar et al., *J. Biosci.* (Bangalore) 11:47-58, 1987. Transformation of insect cells and production of foreign polypeptides therein is disclosed by Guarino et al., U.S. Pat. No. 5,162,222 and WIPO publication WO 94/06463.

Insect cells can be infected with recombinant baculovirus, commonly derived from *Autographa californica* nuclear polyhedrosis virus (AcNPV). See King and Possee, *The Baculovirus Expression System: A Laboratory Guide* (Chapman & Hall, London); O'Reilly et al., *Baculovirus Expression Vectors: A Laboratory Manual* (Oxford University Press, New York 1994); and *Baculovirus Expression Protocols. Methods in Molecular Biology* (Richardson ed., Humana Press, Totowa, N.J., 1995). Recombinant baculovirus can also be produced through the use of a transposon-based system described by Luckow et al. (*J. Virol.* 67:4566-4579, 1993). This system, which utilizes transfer vectors, is commercially available in kit form (BAC-TO-BAC kit; Life Technologies, Gaithersburg, Md.). The transfer vector (e.g., PFASTBAC1; Life Technologies) contains a Tn7 transposon to move the DNA encoding the protein of interest into a baculovirus genome maintained in *E. coli* as a large plasmid called a "bacmid." See Hill-Perkins and Possee, *J. Gen. Virol.* 71:971-976, 1990; Bonning et al., *J. Gen. Virol.* 75:1551-1556, 1994; and Chazenbalk and Rapoport, *J. Biol. Chem.* 270:1543-1549, 1995. In addition, transfer vectors can include an in-frame fusion with DNA encoding a polypeptide extension or affinity tag as disclosed above. Using techniques known in the art, a transfer vector containing a protein-encoding DNA sequence is transformed into *E. coli* host cells, and the cells are screened for bacmids which contain an interrupted lacZ gene indicative of recombinant baculovirus. The bacmid DNA containing the recombinant baculovirus genome is isolated, using common techniques, and used to transfect *Spodoptera frugiperda* cells, such as Sf9 cells. Recombinant virus that expresses the protein or interest is subsequently produced. Recombinant viral stocks are made by methods commonly used in the art.

For protein production, the recombinant virus is used to infect host cells, typically a cell line derived from the fall armyworm, *Spodoptera frugiperda* (e.g., Sf9 or Sf21 cells) or *Trichoplusia ni* (e.g., HIGH FIVE cells; Invitrogen, Carlsbad, Calif.). See generally Glick and Pasternak, *Molecular Biotechnology, Principles & Applications of Recombinant DNA* (ASM Press, Washington, D.C., 1994). See also U.S. Pat. No. 5,300,435. Serum-free media are used to grow and maintain the cells. Suitable media formulations are known in the art and can be obtained from commercial suppliers. The cells are grown up from an inoculation density of approximately $2-5 \times 10^5$ cells to a density of $1-2 \times 10^6$ cells, at which time a recombinant viral stock is added at a multiplicity of infection (MOI) of 0.1 to 10, more typically near 3. Procedures used are generally described in available laboratory manuals (see, e.g., King and Possee, supra; O'Reilly et al., supra; Richardson, supra).

Fungal cells, including yeast cells, can also be used within the present invention. Yeast species of particular interest in this regard include *Saccharomyces cerevisiae, Pichia pastoris*, and *Pichia methanolica*. Methods for transforming *S. cerevisiae* cells with exogenous DNA and producing recombinant polypeptides therefrom are disclosed by, for example, Kawasaki, U.S. Pat. No. 4,599,311; Kawasaki et al., U.S. Pat. No. 4,931,373; Brake, U.S. Pat. No. 4,870,008; Welch et al., U.S. Pat. No. 5,037,743; and Murray et al., U.S. Pat. No. 4,845,075. Transformed cells are selected by phenotype determined by the selectable marker, commonly drug resistance or the ability to grow in the absence of a particular nutrient (e.g., leucine). An exemplary vector system for use in *Saccharomyces cerevisiae* is the POT1 vector system disclosed by Kawasaki et al. (U.S. Pat. No. 4,931,373), which allows transformed cells to be selected by growth in glucose-containing media. Suitable promoters and terminators for use in yeast include those from glycolytic enzyme genes (see, e.g., Kawasaki, U.S. Pat. No. 4,599,311; Kingsman et al., U.S. Pat. No. 4,615,974; and Bitter, U.S. Pat. No. 4,977,092) and alcohol dehydrogenase genes. See also U.S. Pat. Nos. 4,990,446; 5,063,154; 5,139,936; and 4,661,454. Transformation systems for other yeasts, including *Hansenula polymorpha, Schizosaccharomyces pombe, Kluyveromyces lactis, Kluyveromyces fragilis, Ustilago maydis, Pichia pastoris, Pichia methanolica, Pichia guillermondii*, and *Candida maltosa* are known in the art. See, e.g., Gleeson et al., *J. Gen. Microbiol.* 132:3459-3465, 1986; Cregg, U.S. Pat. No. 4,882,279; and Raymond et al., *Yeast* 14:11-23, 1998. *Aspergillus* cells may be utilized according to the methods of McKnight et al., U.S. Pat. No. 4,935,349. Methods for transforming *Acremonium chrysogenum* are disclosed by Sumino et al., U.S. Pat. No. 5,162,228. Methods for transforming *Neurospora* are disclosed by Lambowitz, U.S. Pat. No. 4,486,533. Production of recombinant proteins in *Pichia methanolica* is disclosed in U.S. Pat. Nos. 5,716,808; 5,736,383; 5,854,039; and 5,888,768.

Prokaryotic host cells, including strains of the bacteria *Escherichia coli, Bacillus*, and other genera are also useful host cells within the present invention. Techniques for transforming these hosts and expressing foreign DNA sequences cloned therein are well known in the art (see, e.g., Sambrook et al., supra). When expressing a recombinant protein in bacteria such as *E. coli*, the protein may be retained in the cytoplasm, typically as insoluble granules, or may be directed to the periplasmic space by a bacterial secretion sequence. In the former case, the cells are lysed, and the granules are recovered and denatured using, for example, guanidine isothiocyanate or urea. The denatured protein can then be refolded and dimerized by diluting the denaturant, such as by dialysis against a solution of urea and a combination of reduced and oxidized glutathione, followed by dialysis against a buffered saline solution. In the alternative, the protein may be recovered from the cytoplasm in soluble form and isolated without the use of denaturants. The protein is recovered from the cell as an aqueous extract in, for example, phosphate buffered saline. To capture the protein of interest, the extract is applied directly to a chromatographic medium, such as an immobilized antibody or heparin-Sepharose column. Secreted proteins can be recovered from the periplasmic space in a soluble and functional form by disrupting the cells (by, for example, sonication or osmotic shock) to release the contents of the periplasmic space and recovering the protein, thereby obviating the need for denaturation and refolding. Antibodies, including single-chain antibodies, can be produced in bacterial host cells according to known methods. See, e.g., Bird et al., *Science* 242:423-426, 1988; Huston et al., *Proc. Natl. Acad. Sci. USA* 85:5879-5883, 1988; and Pantoliano et al., *Biochem.* 30:10117-10125, 1991.

Transformed or transfected host cells are cultured according to conventional procedures in a culture medium containing nutrients and other components required for the growth of the chosen host cells. A variety of suitable media, including defined media and complex media, are known in the art and generally include a carbon source, a nitrogen source, essential amino acids, vitamins and minerals. Media may also contain such components as growth factors or serum, as required. The growth medium will generally select for cells containing the exogenously added DNA by, for example, drug selection or deficiency in an essential nutrient which is complemented by the selectable marker carried on the expression vector or co-transfected into the host cell.

VEGF-A and PDGFRβ antagonist proteins are purified by conventional protein purification methods, typically by a combination of chromatographic techniques. See generally *Affinity Chromatography Principles & Methods* (Pharmacia LKB Biotechnology, Uppsala, Sweden, 1988); Scopes, *Pro-*

*tein Purification: Principles and Practice* (Springer-Verlag, New York 1994). Proteins comprising an immunoglobulin heavy chain polypeptide can be purified by affinity chromatography on immobilized protein A. Additional purification steps, such as gel filtration, can be used to obtain the desired level of purity or to provide for desalting, buffer exchange, and the like.

Antibodies can be purified from cell culture media by known methods, such as affinity chromatography using conventional columns and other equipment. In a typical procedure, conditioned medium is harvested and may be stored at 4° C. for up to five days. To avoid contamination, a bacteriostatic agent (e.g., sodium azide) is generally added. The pH of the medium is lowered (typically to Ph ~5.5), such as by the addition of glacial acetic acid dropwise. The lower pH provides for optimal capture of IgG via a protein G resin. The protein G column size is determined based on the volume of the conditioned medium. The packed column is neutralized with a suitable buffer, such as 35 mM $NaPO_4$, 120 mM NaCl pH 7.2. The medium is then passed over the neutralized protein g resin at a flow rate determined by both the volume of the medium and of the column size. The flowthrough is retained for possible additional passes over the column. The resin with the captured antibody is then washed into the neutralizing buffer. The column is eluted into fractions using an acidic elution buffer, such as 0.1M glycine, pH 2.7 or equivalent. Each fraction is neutralized, such as with 2M tris, pH 8.0 at a 1:20 ratio tris:glycine. Protein containing fractions (e.g., based on $A_{280}$) are pooled. The pooled fractions are buffer exchanged into a suitable buffer, such as 35 mM $NaPO_4$, 120 mM NaCl pH 7.2 using a desalting column. Concentration is determined by $A_{280}$ using an extinction coefficient of 1.44. Endotoxin levels may be determined by LAL assay. Purified protein may be stored frozen, typically at −80° C.

IV. Methods of Treatment

A. General

In another aspect, the present invention provides methods of inhibiting angiogenesis, particularly methods for treatment of diseases or disorders associated with angiogenesis. Generally, such methods include administering to a subject a PDGFRβ and/or VEGF-A antagonist in an amount effective to inhibit angiogenesis. More particularly, for therapeutic use, the PDGFRβ and/or VEGF-A antagonist is administered to a subject suffering from, or at an elevated risk of developing, a disease or disorder characterized by increased angiogenesis (a "neovascular disorder"). Neovascular disorders amenable to treatment in accordance with the present invention include, for example, cancers characterized by solid tumor growth (e.g., pancreatic cancer, renal cell carcinoma (RCC), colorectal cancer, non-small cell lung cancer (NSCLC), and gastrointestinal stromal tumor (GIST)) as well as various neovascular ocular disorders (e.g., age-related macular degeneration, diabetic retinopathy, iris neovascularization, and neovascular glaucoma). Other neovascular disorders amenable to treatment in accordance with the present invention include, for example, rheumatoid arthritis, psoriasis, atherosclerosis, chronic inflammation, lung inflammation, preeclampsia, pericardial effusion (such as that associated with pericarditis), and pleural effusion.

In certain embodiments comprising the use of a PDGFRβ antagonist, the PDGFRβ antagonist is an anti-PDGFRβ antibody as described herein. In some such variations, the anti-PDGFRβ antibody is used in combination with a VEGF-A antagonist, such as, for example, a neutralizing antibody that specifically binds to VEGF-A or to a VEGF-A receptor.

In other embodiments comprising the use of a VEGF-A antagonist, the VEGF-A antagonist is an anti-VEGF-A antibody as described herein. In some such variations, the anti-VEGF-A antibody is used in combination with a PDGFRβ antagonist, such as, for example, a neutralizing antibody that specifically binds to PDGFRβ or to a PDGF ligand (e.g., PDGF-B or PDGF-D).

In preferred variations, both a PDGFRβ and a VEGF-A antagonist are used. Particularly preferred are the use of a neutralizing anti-PDGFRβ antibody as described herein in combination with a neutralizing anti-VEGF-A antibody as described herein.

In each embodiments comprising the use of an PDGFRβ antagonists in combination with a VEGF-A antagonist, the PDGFRβ antagonists and VEGF-A antagonist may be administered either simultaneously or separately (e.g., at different times and/or at separate administration sites). Accordingly, in certain variations comprising the simultaneous administration of a PDGFRβ antagonist and a VEGF-A antagonist, the method includes administration of a bispecific binding composition comprising (a) an antibody that specially binds to the extracellular domain of PDGFRβ and neutralizes PDGFRβ activity and (b) an antibody that specifically binds to VEGF-A and neutralizes VEGF-A activity. In particularly preferred embodiments, administration of the PDGFRβ antagonist and the VEGF-A antagonist comprises administering a bispecific antibody that binds to and neutralizes both PDGFRβ and VEGF-A. In certain embodiments comprising separate administration of a PDGFRβ antagonists and a VEGF-A antagonist, the PDGFRβ antagonist and VEGF-A antagonist are administered sequentially. In such embodiments, the administration of each agent can be by the same or different methods.

In each of the embodiments of the treatment methods described herein, the PDGFRβ and/or VEGF-A antagonist is delivered in a manner consistent with conventional methodologies associated with management of the disease or disorder for which treatment is sought. In accordance with the disclosure herein, an effective amount of the antagonists is administered to a subject in need of such treatment for a time and under conditions sufficient to prevent or treat the disease or disorder.

Subjects for administration antagonists as described herein include patients at high risk for developing a particular disease or disorder associated with angiogenesis as well as patients presenting with an existing neovascular disorder. In certain embodiments, the subject has been diagnosed as having the disease or disorder for which treatment is sought. Further, subjects can be monitored during the course of treatment for any change in the disease or disorder (e.g., for an increase or decrease in clinical symptoms of the disease or disorder). Also, in some variations, the subject does not suffer from another disease or disorder requiring treatment that involves inhibiting either or both of the PDGFRβ and VEGF-A pathways.

In prophylactic applications, pharmaceutical compositions or medicants are administered to a patient susceptible to, or otherwise at risk of, a particular disease in an amount sufficient to eliminate or reduce the risk or delay the outset of the disease. In therapeutic applications, compositions or medicants are administered to a patient suspected of, or already suffering from such a disease in an amount sufficient to cure, or at least partially arrest, the symptoms of the disease and its complications. An amount adequate to accomplish this is referred to as a therapeutically- or pharmaceutically-effective dose or amount. In both prophylactic and therapeutic regimes, agents are usually administered in several dosages until a sufficient response (e.g., inhibition of inappropriate angiogenesis activity) has been achieved. Typically, the response is monitored and repeated dosages are given if the desired response starts to fade.

To identify subject patients for treatment according to the methods of the invention, accepted screening methods may be employed to determine risk factors associated with specific neovascular disorders or to determine the status of an existing disorder identified in a subject. Such methods can include, for example, determining whether an individual has relatives who have been diagnosed with a particular disease. Screening methods can also include, for example, conventional work-ups to determine familial status for a particular disease known to have a heritable component. For example, various cancers are also known to have certain inheritable components. Inheritable components of cancers include, for example, mutations in multiple genes that are transforming (e.g., Ras, Raf, EGFR, cMet, and others), the presence or absence of certain HLA and killer inhibitory receptor (KIR) molecules, or mechanisms by which cancer cells are able to modulate immune suppression of cells like NK cells and T cells, either directly or indirectly (see, e.g., Ljunggren and Malmberg, *Nature Rev. Immunol.* 7:329-339, 2007; Boyton and Altmann, *Clin. Exp. Immunol.* 149:1-8, 2007). Toward this end, nucleotide probes can be routinely employed to identify individuals carrying genetic markers associated with a particular disease of interest. In addition, a wide variety of immunological methods are known in the art that are useful to identify markers for specific diseases. For example, various ELISA immunoassay methods are available and well-known in the art that employ monoclonal antibody probes to detect antigens associated with specific tumors. Screening may be implemented as indicated by known patient symptomology, age factors, related risk factors, etc. These methods allow the clinician to routinely select patients in need of the methods described herein for treatment. In accordance with these methods, inhibition of angiogenesis may be implemented as an independent treatment program or as a follow-up, adjunct, or coordinate treatment regimen to other treatments.

For administration, the PDGFRβ and/or VEGF-A antagonist is formulated as a pharmaceutical composition. A pharmaceutical composition comprising a PDGFRβ and/or VEGF-A antagonist can be formulated according to known methods to prepare pharmaceutically useful compositions, whereby the therapeutic molecule is combined in a mixture with a pharmaceutically acceptable carrier. A composition is said to be a "pharmaceutically acceptable carrier" if its administration can be tolerated by a recipient patient. Sterile phosphate-buffered saline is one example of a pharmaceutically acceptable carrier. Other suitable carriers are well-known to those in the art. (See, e.g., Gennaro (ed.), *Remington's Pharmaceutical Sciences* (Mack Publishing Company, 19th ed. 1995).) Formulations may further include one or more excipients, preservatives, solubilizers, buffering agents, albumin to prevent protein loss on vial surfaces, etc. Monospecific antagonists can be individually formulated or provided in a combined formulation.

A pharmaceutical composition comprising a PDGFRβ and/or VEGF-A antagonist is administered to a subject in an effective amount. According to the methods of the present invention, an antagonist may be administered to subjects by a variety of administration modes, including, for example, by intramuscular, subcutaneous, intravenous, intra-atrial, intra-articular, parenteral, intranasal, intrapulmonary, transdermal, intrapleural, intrathecal, and oral routes of administration. For pharmaceutical use for treatment of neovascular ocular disorders, the PDGFRβ and/or VEGF-A antagonists are typically formulated for intravitreal injection according to conventional methods. For prevention and treatment purposes, an antagonist may be administered to a subject in a single bolus delivery, via continuous delivery (e.g., continuous transdermal delivery) over an extended time period, or in a repeated administration protocol (e.g., on an hourly, daily, or weekly basis).

A "therapeutically effective amount" of a composition is that amount that produces a statistically significant effect, such as a statistically significant reduction in disease progression or a statistically significant improvement in organ function. The exact dose will be determined by the clinician according to accepted standards, taking into account the nature and severity of the condition to be treated, patient traits, etc. Determination of dose is within the level of ordinary skill in the art.

Determination of effective dosages in this context is typically based on animal model studies followed up by human clinical trials and is guided by determining effective dosages and administration protocols that significantly reduce the occurrence or severity of the subject disease or disorder in model subjects. Effective doses of the compositions of the present invention vary depending upon many different factors, including means of administration, target site, physiological state of the patient, whether the patient is human or an animal, other medications administered, whether treatment is prophylactic or therapeutic, as well as the specific activity of the composition itself and its ability to elicit the desired response in the individual. Usually, the patient is a human, but in some diseases, the patient can be a nonhuman mammal. Typically, dosage regimens are adjusted to provide an optimum therapeutic response, i.e., to optimize safety and efficacy. Accordingly, a therapeutically or prophylactically effective amount is also one in which any undesired collateral effects are outweighed by beneficial effects of inhibiting angiogenesis. For administration of a PDGFRβ and/or VEGF-A antagonist, a dosage typically ranges from about 0.1 μg to 100 mg/kg or 1 μg/kg to about 50 mg/kg, and more usually 10 μg to 5 mg/kg of the subject's body weight. In more specific embodiments, an effective amount of the agent is between about 1 μg/kg and about 20 mg/kg, between about 10 μg/kg and 10 mg/kg, or between about 0.1 mg/kg and about 5 mg/kg. Dosages within this range can be achieved by single or multiple administrations, including, e.g., multiple administrations per day or daily, weekly, bi-weekly, or monthly administrations. For example, in certain variations, a regimen consists of an initial administration followed by multiple, subsequent administrations at weekly or bi-weekly intervals. Another regimen consists of an initial administration followed by multiple, subsequent administrations at monthly or bi-monthly intervals. Alternatively, administrations can be on an irregular basis as indicated by monitoring of NK cell activity and/or clinical symptoms of the disease or disorder.

Dosage of the pharmaceutical composition may be varied by the attending clinician to maintain a desired concentration at a target site. For example, if an intravenous mode of delivery is selected, local concentration of the agent in the bloodstream at the target tissue may be between about 1-50 nanomoles of the composition per liter, sometimes between about 1.0 nanomole per liter and 10, 15, or 25 nanomoles per liter depending on the subject's status and projected measured response. Higher or lower concentrations may be selected based on the mode of delivery, e.g., trans-epidermal delivery versus delivery to a mucosal surface. Dosage should also be adjusted based on the release rate of the administered formulation, e.g., nasal spray versus powder, sustained release oral or injected particles, transdermal formulations, etc. To achieve the same serum concentration level, for example, slow-release particles with a release rate of 5 nanomolar (under standard conditions) would be administered at about twice the dosage of particles with a release rate of 10 nanomolar.

A pharmaceutical composition comprising a PDGFRβ and/or VEGF-A antagonist can be furnished in liquid form, in an aerosol, or in solid form. Liquid forms, are illustrated by injectable solutions, aerosols, droplets, topological solutions and oral suspensions. Exemplary solid forms include capsules, tablets, and controlled-release forms. The latter form is illustrated by miniosmotic pumps and implants. (See, e.g., Bremer et al., *Pharm. Biotechnol.* 10:239, 1997; Ranade, "Implants in Drug Delivery," in *Drug Delivery Systems* 95-123 (Ranade and Hollinger, eds., CRC Press 1995); Bremer et al., "Protein Delivery with Infusion Pumps," in *Protein Delivery: Physical Systems* 239-254 (Sanders and Hendren, eds., Plenum Press 1997); Yewey et al., "Delivery of Proteins from a Controlled Release Injectable Implant," in *Protein Delivery: Physical Systems* 93-117 (Sanders and Hendren, eds., Plenum Press 1997).) Other solid forms include creams, pastes, other topological applications, and the like.

Liposomes provide one means to deliver therapeutic polypeptides to a subject, e.g., intravenously, intraperitoneally, intrathecally, intramuscularly, subcutaneously, or via oral administration, inhalation, or intranasal administration. Liposomes are microscopic vesicles that consist of one or more lipid bilayers surrounding aqueous compartments. (See, generally, Bakker-Woudenberg et al., *Eur. J. Clin. Microbial. Infect. Dis.* 12 (Suppl 1):S61, 1993; Kim, *Drugs* 46:618, 1993; Ranade, "Site-Specific Drug Delivery Using Liposomes as Carriers," in *Drug Delivery Systems* 3-24 (Ranade and Hollinger, eds., CRC Press 1995).) Liposomes are similar in composition to cellular membranes and as a result, liposomes can be administered safely and are biodegradable. Depending on the method of preparation, liposomes may be unilamellar or multilamellar, and liposomes can vary in size with diameters ranging from 0.02 μm to greater than 10 μm. A variety of agents can be encapsulated in liposomes: hydrophobic agents partition in the bilayers and hydrophilic agents partition within the inner aqueous space(s). (See, e.g., Machy et al., *Liposomes In Cell Biology And Pharmacology* (John Libbey 1987); Ostro et al., *American J. Hosp. Pharm.* 46:1576, 1989.) Moreover, it is possible to control the therapeutic availability of the encapsulated agent by varying liposome size, the number of bilayers, lipid composition, as well as the charge and surface characteristics of the liposomes.

Liposomes can adsorb to virtually any type of cell and then slowly release the encapsulated agent. Alternatively, an absorbed liposome may be endocytosed by cells that are phagocytic. Endocytosis is followed by intralysosomal degradation of liposomal lipids and release of the encapsulated agents (see Scherphof et al., *Ann. N.Y. Acad. Sci.* 446:368, 1985). After intravenous administration, small liposomes (0.1 to 1.0 μm) are typically taken up by cells of the reticuloendothelial system, located principally in the liver and spleen, whereas liposomes larger than 3.0 μm are deposited in the lung. This preferential uptake of smaller liposomes by the cells of the reticuloendothelial system has been used to deliver chemotherapeutic agents to macrophages and to tumors of the liver.

The reticuloendothelial system can be circumvented by several methods including saturation with large doses of liposome particles, or selective macrophage inactivation by pharmacological means (see Claassen et al., *Biochim. Biophys. Acta* 802:428, 1984). In addition, incorporation of glycolipid- or polyethelene glycol-derivatized phospholipids into liposome membranes has been shown to result in a significantly reduced uptake by the reticuloendothelial system (see Allen et al., *Biochim. Biophys. Acta* 1068:133, 1991; Allen et al., *Biochim. Biophys. Acta* 1150:9, 1993).

Liposomes can also be prepared to target particular cells or organs by varying phospholipid composition or by inserting receptors or counter-receptors into the liposomes. For example, liposomes, prepared with a high content of a nonionic surfactant, have been used to target the liver. (See, e.g., Japanese Patent 04-244,018 to Hayakawa et al.; Kato et al., *Biol. Pharm. Bull* 16:960, 1993.) These formulations were prepared by mixing soybean phospatidylcholine, α-tocopherol, and ethoxylated hydrogenated castor oil (HCO-60) in methanol, concentrating the mixture under vacuum, and then reconstituting the mixture with water. A liposomal formulation of dipalmitoylphosphatidylcholine (DPPC) with a soybean-derived sterylglucoside mixture (SG) and cholesterol (Ch) has also been shown to target the liver. (See Shimizu et al., *Biol. Pharm. Bull* 20:881, 1997.)

Alternatively, various targeting counter-receptors can be bound to the surface of the liposome, such as antibodies, antibody fragments, carbohydrates, vitamins, and transport proteins. For example, for targeting to the liver, liposomes can be modified with branched type galactosyllipid derivatives to target asialoglycoprotein (galactose) receptors, which are exclusively expressed on the surface of liver cells. (See Kato and Sugiyama, *Crit. Rev. Ther. Drug Carrier Syst.* 14:287, 1997; Murahashi et al., *Biol. Pharm. Bull.* 20:259, 1997.) In a more general approach to tissue targeting, target cells are prelabeled with biotinylated antibodies specific for a counter-receptor expressed by the target cell. (See Harasym et al., *Adv. Drug Deliv. Rev.* 32:99, 1998.) After plasma elimination of free antibody, streptavidin-conjugated liposomes are administered. In another approach, targeting antibodies are directly attached to liposomes. (See Harasym et al., supra.)

Polypeptides and antibodies can be encapsulated within liposomes using standard techniques of protein microencapsulation. (See, e.g., Anderson et al., *Infect. Immun.* 31:1099, 1981; Anderson et al., *Cancer Res.* 50:1853, 1990; Cohen et al., *Biochim. Biophys. Acta* 1063:95, 1991; Alving et al. "Preparation and Use of Liposomes in Immunological Studies," in *Liposome Technology* (Vol. III) 317 (Gregoriadis, ed., CRC Press, 2nd ed. 1993); Wassef et al., *Meth. Enzymol.* 149:124, 1987.) As noted above, therapeutically useful liposomes may contain a variety of components. For example, liposomes may comprise lipid derivatives of poly (ethylene glycol). (See Allen et al., *Biochim. Biophys. Acta* 1150:9, 1993.)

Degradable polymer micro spheres have been designed to maintain high systemic levels of therapeutic proteins. Micro spheres are prepared from degradable polymers such as poly(lactide-co-glycolide) (PLG), polyanhydrides, poly (ortho esters), nonbiodegradable ethylvinyl acetate polymers, in which proteins are entrapped in the polymer. (See, e.g., Gombotz and Pettit, *Bioconjugate Chem.* 6:332, 1995; Ranade, "Role of Polymers in Drug Delivery," in *Drug Delivery Systems* 51-93 (Ranade and Hollinger, eds., CRC Press 1995); Roskos and Maskiewicz, "Degradable Controlled Release Systems Useful for Protein Delivery," in *Protein Delivery: Physical Systems* 45-92 (Sanders and Hendren, eds., Plenum Press 1997); Bartus et al., *Science* 281:1161, 1998; Putney and Burke, *Nature Biotechnology* 16:153, 1998; Putney, *Curr. Opin. Chem. Biol.* 2:548, 1998.) Polyethylene glycol (PEG)-coated nanospheres can also provide carriers for intravenous administration of therapeutic proteins. (See, e.g., Gref et al., *Pharm. Biotechnol.* 10:167, 1997.)

Other dosage forms can be devised by those skilled in the art, as shown by, e.g., Ansel and Popovich, *Pharmaceutical Dosage Forms and Drug Delivery Systems* (Lea & Febiger, 5th ed. 1990); Gennaro (ed.), *Remington's Pharmaceutical Sciences* (Mack Publishing Company, 19th ed. 1995), and Ranade and Hollinger, *Drug Delivery Systems* (CRC Press 1996).

Pharmaceutical compositions as described herein may also be used in the context of combination therapy. The term "combination therapy" is used herein to denote that a subject is administered at least one therapeutically effective dose of a PDGFRβ and/or VEGF-A antagonist and another therapeutic agent. The PDGFRβ and/or VEGF-A antagonist may be, for example, a bispecific binding composition that binds and neutralizes both PDGFRβ and VEGF-A. In particularly preferred variations, the bispecific binding composition is a bispecific antibody as described herein.

For example, in the context of cancer immunotherapy, compositions having PDGFRβ and/or VEGF-A antagonist activity can be used as an angiogenesis inhibition agent in combination with chemotherapy or radiation. PDGFRβ and/or VEGF-A antagonists can work in synergy with conventional types of chemotherapy or radiation. PDGFRβ and/or VEGF-A antagonists can further reduce tumor burden and allow more efficient killing by the chemotherapeutic.

Compositions of the present invention demonstrating angiogenesis inhibiting activity can also be used in combination with immunomodulatory compounds including various cytokines and co-stimulatory/inhibitory molecules. These could include, but are not limited to, the use of cytokines that stimulate anti-cancer immune responses. For instance, the combined use of IL-2 and IL-12 shows beneficial effects in T-cell lymphoma, squamous cell carcinoma, and lung cancer. (See Zaki et al., *J. Invest. Dermatol.* 118:366-71, 2002; Li et al., *Arch. Otolaryngol. Head Neck Surg.* 127:1319-24, 2001; Hiraki et al., *Lung Cancer* 35:329-33, 2002.) In addition, PDGFRβ and/or VEGF-A antagonists could be combined with reagents that co-stimulate various cell surface molecules found on immune-based effector cells, such as the activation of CD137. (See Wilcox et al., *J. Clin. Invest.* 109:651-9, 2002) or inhibition of CTLA4 (Chambers et al., *Ann. Rev. Immunol.* 19:565-94, 2001). Alternatively, PDGFRβ and/or VEGF-A antagonists could be used with reagents that induce tumor cell apoptosis by interacting with TRAIL-related receptors. (See, e.g., Takeda et al., *J. Exp. Med.* 195:161-9, 2002; Srivastava, *Neoplasia* 3:535-46, 2001.) Such reagents include TRAIL ligand, TRAIL ligand-Ig fusions, anti-TRAIL antibodies, and the like.

In other variations, a PDGFRβ and/or VEGF-A antagonist is used in combination with a monoclonal antibody therapy that does not specifically target angiogenesis. Such combination therapy is particularly useful for treatment of cancer, in which the use of monoclonal antibodies, particularly antibodies directed against tumor-expressed antigens, is becoming a standard practice for many tumors including breast cell carcinoma (trastuzumab or HERCEPTIN®) and colon carcinoma (cetuximab or ERBITUX®).

Pharmaceutical compositions may be supplied as a kit comprising a container that comprises a therapeutic compositions as described herein. A therapeutic composition can be provided, for example, in the form of an injectable solution for single or multiple doses, or as a sterile powder that will be reconstituted before injection. Alternatively, such a kit can include a dry-powder disperser, liquid aerosol generator, or nebulizer for administration of a therapeutic composition. Such a kit may further comprise written information on indications and usage of the pharmaceutical composition.

B. Cancer Treatment

1. Types of Cancer

Cancers amenable to treatment in accordance with the present invention include cancers characterized by the presence of solid tumors. As previously discussed, the quantity of blood vessels in a tumor tissue is a strong negative prognostic indicator for cancers involving solid tumor formation, (see, e.g., Weidner et al., (1992), supra; Weidner et al., (1993), supra; Li et al., supra; Foss et al., supra), and both the VEGF and PDGF family of signaling molecules appear to play key roles in the development of new blood vessels associated with solid tumors. Table 7 below lists some cancers characterized by solid tumor formation, organized predominantly by target tissues.

TABLE 7

Exemplary Cancers Involving Solid Tumor Formation

1. Head and Neck cancer
   a. Brain
   b. Oral cavity
   c. Orophyarynx
   d. Nasopharynx
   e. Hypopharynx
   f. Nasal cavities and paranasal sinuses
   g. Larynx
   h. Lip
2. Lung cancers
   a. Non-small cell carcinoma
   b. Small cell carcinoma
3. Gastrointestinal Tract cancers
   a. Colorectal cancer
   b. Gastric cancer
   c. Esophageal cancer
   d. Anal cancer
   e. Extrahepatic Bile Duct cancer
   f. Cancer of the Ampulla of Vater
   g. Gastrointestinal Stromal Tumor (GIST)
4. Liver cancer
   a. Liver Cell Adenoma
   b. Hepatocellular Carcinoma
5. Breast cancer
6. Gynecologic cancer
   a. Cervical cancer
   b. Ovarian cancer
   c. Vaginal cancer
   d. Vulvar cancer
   e. Gestational Trophoblastic Neoplasia
   f. Uterine cancer
7. Urinary Tract cancer
   a. Renal cancer carcinoma
   b. Prostate cancer
   c. Urinary Bladder cancer
   d. Penile cancer
   e. Urethral cancer
8. Urinary Bladder cancer
9. Neurological Tumors
   a. Astrocytoma and glioblastoma
   b. Primary CNS lymphoma
   c. Medulloblastoma
   d. Germ Cell tumors
   e. Retinoblastoma TABLE 7-continued Exemplary Cancers Involving Solid Tumor Formation 10. Endocrine Neoplasms
    a. Thyroid cancer
    b. Pancreatic cancer
        1) Islet Cell tumors
            a) Insulinomas
            b) Glucagonomas
    c. Pheochromocytoma
    d. Adrenal carcinoma
    e. Carcinoid tumors
    f. Parathyroid carcinoma
    g. Pineal gland neoplasms
11. Skin cancers
    a. Malignant melanoma
    b. Squamous Cell carcinoma
    c. Basal Cell carcinoma
    d. Kaposi's Sarcoma
12. Bone cancers
    a. Osteoblastoma
    b. Osteochondroma
    c. Osteosarcoma
13. Connective Tissue neoplasms
    a. Chondroblastoma
    b. Chondroma
14. Childhood Cancers
    a. Brain cancers
    b. Neuroblastoma
    c. Wilm's Tumor (nephroblastoma)
    d. Phabdomyosarcoma
    e. Retinoblastoma
15. Immunotherapeutically sensitive cancers
    a. melanoma
    b. kidney cancer
    c. breast cancer
    d. prostate cancer
    e. colorectal cancer
    f. cervical cancer
    g. ovarian cancer
    h. lung cancer Accordingly, in certain embodiments, a PDGFRβ and/or VEGF-A antagonist as described herein is used to treat a cancer characterized by the presence of a solid tumor, such as, e.g., any of the cancers listed in Table 7. For example, in some embodiments, the cancer to be treated in accordance with the present invention is selected from the following: a cancer of the head and neck (e.g., a cancer of the oral cavity, orophyarynx, nasopharynx, hypopharynx, nasal cavity or paranasal sinuses, larynx, lip, or salivary gland); a lung cancer (e.g., non-small cell lung cancer, small cell carcinoma, or mesothelimia); a gastrointestinal tract cancer (e.g., colorectal cancer, gastric cancer, esophageal cancer, or anal cancer); gastrointestinal stromal tumor (GIST); pancreatic adenocarcinoma; pancreatic acinar cell carcinoma; a cancer of the small intestine; a cancer of the liver or biliary tree (e.g., liver cell adenoma, hepatocellular carcinoma, hemangiosarcoma, extrahepatic or intrahepatic cholangiosarcoma, cancer of the ampulla of vater, or gallbladder cancer); a breast cancer (e.g., metastatic breast cancer or inflammatory breast cancer); a gynecologic cancer (e.g., cervical cancer, ovarian cancer, fallopian tube cancer, peritoneal carcinoma, vaginal cancer, vulvar cancer, gestational trophoblastic neoplasia, or uterine cancer, including endometrial cancer or uterine sarcoma); a cancer of the urinary tract (e.g., prostate cancer; bladder cancer; penile cancer; urethral cancer, or kidney cancer such as, for example, renal cell carcinoma or transitional cell carcinoma, including renal pelvis and ureter); testicular cancer; a cancer of the central nervous system (CNS) such as an intracranial tumor (e.g., astrocytoma, anaplastic astrocytoma, glioblastoma, oligodendroglioma, anaplastic oligodendroglioma, ependymoma, primary CNS lymphoma, medulloblastoma, germ cell tumor, pineal gland neoplasm, meningioma, pituitary tumor, tumor of the nerve sheath (e.g., schwannoma), chordoma, craniopharyngioma, a chloroid plexus tumor (e.g., chloroid plexus carcinoma); or other intracranial tumor of neuronal or glial origin) or a tumor of the spinal cord (e.g., schwannoma, meningioma); an endocrine neoplasm (e.g., thyroid cancer such as, for example, thyroid carcinoma, medullary cancer, or thyroid lymphoma; a pancreatic endocrine tumor such as, for example, an insulinoma or glucagonoma; an adrenal carcinoma such as, for example, pheochromocytoma; a carcinoid tumor; or a parathyroid carcinoma); a skin cancer (e.g., squamous cell carcinoma; basal cell carcinoma; Kaposi's sarcoma; or a malignant melanoma such as, for example, an intraocular melanoma); a bone cancer (e.g., a bone sarcoma such as, for example, osteosarcoma, osteochondroma, or Ewing's sarcoma); multiple myeloma; a chloroma; a soft tissue sarcoma (e.g., a fibrous tumor or fibrohistiocytic tumor); a tumor of the smooth muscle or skeletal muscle; a blood or lymph vessel perivascular tumor (e.g., Kaposi's sarcoma); a synovial tumor; a mesothelial tumor; a neural tumor; a paraganglionic tumor; an extraskeletal cartilaginous or osseous tumor; and a pluripotential mesenchymal tumor.

In some variations, the cancer to be treated is a childhood cancer such as, for example, brain cancer, neuroblastoma, Wilm's tumor (nephroblastoma), rhabdomyosarcoma, retinoblastoma, or hepatoblastoma.

In other variations, the cancer is an immunotherapeutically sensitive cancer such as, for example, melanoma, kidney cancer, breast cancer, prostate cancer, colorectal cancer, cervical cancer, ovarian cancer, or lung cancer.

Some of the cancers listed above, including some of the relevant animal models for evaluating the effects of PDGFRβ and/or VEGF-A antagonist on tumor responses, are discussed in further detail below.

a. Melanoma

Superficial spreading melanoma is the most common type of melanoma. About 7 out of 10 (70%) are this type. They occur mostly in middle-aged people. The most common place in women is on the legs, while in men it is more common on the trunk, particularly the back. They tend to start by spreading out across the surface of the skin: this is known as the radial growth phase. If the melanoma is removed at this stage there is a very high chance of cure. If the melanoma is not removed, it will start to grow down deeper into the layers of the skin. There is then a risk that it will spread in the bloodstream or lymph system to other parts of the body. Nodular melanoma occurs most often on the chest or back. It is most commonly found in middle-aged people. It tends to grow deeper into the skin quite quickly if it is not removed. This type of melanoma is often raised above the rest of the skin surface and feels like a bump. It may be very dark brown-black or black. Lentigo maligna melanoma is most commonly found on the face, particularly in older people. It grows slowly and may take several years to develop. Acral melanoma is usually found on the palms of the hands, soles of the feet or around the toenails. Other very rare types of melanoma of the skin include amelanotic melanoma (in which the melanoma loses its pigment and appears as a white area) and desmoplastic melanoma (which contains fibrous scar tissue). Malignant melanoma can start in parts of the body other than the skin but this is very rare. The parts of the body that may be affected are the eye, the mouth, under the fingernails (known as subungual melanoma) the vulval or vaginal tissues, or internally.

Most melanomas start with a change in the appearance of normal skin. This can look like an abnormal new mole. Less than a third develop in existing moles. It can be difficult to tell the difference between a mole and a melanoma, but the following checklist can be used to help. It is known as the ABCD list. Asymmetry—Ordinary moles are usually symmetrical in shape. Melanomas are likely to be irregular or asymmetrical. Border—Moles usually have a well-defined regular border. Melanomas are more likely to have an irregular border with jagged edges. Colour—Moles are usually a uniform brown. Melanomas tend to have more than one colour. They may be varying shades of brown mixed with black, red, pink, white or a bluish tint. Diameter—Moles are normally no bigger than the blunt end of a pencil (about 6 mm across). Melanomas are usually more than 7 mm in diameter. Normal moles can be raised up from the skin and/or may be hairy. Itching, crusting or bleeding may also occur in melanomas—these are less common signs but should not be ignored (cancerbacup internet website). The effects of a PDGFRβ and/or VEGF-A antagonist on tumor response can be evaluated in a murine melanoma model similar to that described in Hermans et al., *Cancer Res.* 63:8408-13, 2003; Ramont et al., *Exp. Cell Res.* 29:1-10, 2003; Safwat et al., *J. Exp. Ther. Oncol.* 3:161-8, 2003; and Fidler, Nat New Biol. 242:148-9, 1973.

b. Renal Cell Carcinoma

Renal cell carcinoma, a form of kidney cancer that involves cancerous changes in the cells of the renal tubule, is the most common type of kidney cancer in adults. Why the cells become cancerous is not known. A history of smoking greatly increases the risk for developing renal cell carcinoma. Some people may also have inherited an increased risk to develop renal cell carcinoma, and a family history of kidney cancer increases the risk. People with von Hippel-Lindau disease, a hereditary disease that affects the capillaries of the brain, commonly also develop renal cell carcinoma. Kidney disorders that require dialysis for treatment also increase the risk for developing renal cell carcinoma. The first symptom is usually blood in the urine. Sometimes both kidneys are involved. The cancer metastasizes or spreads easily, most often to the lungs and other organs, and about one-third of patients have metastasis at the time of diagnosis (Medline Plus Medical Encyclopedia Internet website). The effects of an a PDGFRβ and/or VEGF-A antagonist on tumor response can be evaluated in a murine renal cell carcinoma model similar to that described in Sayers et al., *Cancer Res.* 50:5414-20, 1990; Salup et al., *Immunol.* 138:641-7, 1987; and Luan et al., *Transplantation* 73:1565-72, 2002.

c. Cervical Cancer

The cervix is the neck of the uterus that opens into the vagina. Cervical cancer, also called cervical carcinoma, develops from abnormal cells on the surface of the cervix. Cervical cancer is one of the most common cancers affecting women. Cervical cancer is usually preceded by dysplasia, precancerous changes in the cells on the surface of the cervix. These abnormal cells can progress to invasive cancer. Once the cancer appears it can progress through four stages. The stages are defined by the extent of spread of the cancer. The more the cancer has spread, the more extensive the treatment is likely to be. There are 2 main types of cervical cancer: (1) Squamous type (epidermoid cancer): This is the most common type, accounting for about 80% to 85% of cervical cancers. This cancer may be caused by sexually transmitted diseases. One such sexual disease is the human papillomavirus, which causes venereal warts. The cancerous tumor grows on and into the cervix. This cancer generally starts on the surface of the cervix and may be diagnosed at an early stage by a Pap smear. (2) Adenocarcinoma: This type of cervical cancer develops from the tissue in the cervical glands in the canal of the cervix. Early cervical cancer usually causes no symptoms. The cancer is usually detected by a Pap smear and pelvic exam. This is why you should start having Pap smears and pelvic exams as soon as you become sexually active. Healthy young women who have never been sexually active should have their first annual pelvic exam by age 18. Later stages of cervical cancer cause abnormal vaginal bleeding or a blood-stained discharge at unexpected times, such as between menstrual periods, after intercourse, or after menopause. Abnormal vaginal discharge may be cloudy or bloody or may contain mucus with a bad odor. Advanced stages of the cancer may cause pain (University of Michigan Health System Internet website). The effects of a PDGFRβ and/or VEGF-A antagonist on tumor response can be evaluated in a murine cervical cancer model similar to that described in Ahn et al., *Hum. Gene Ther.* 14:1389-99, 2003; Hussain et al., *Oncology* 49:237-40, 1992; and Sengupta et al., *Oncology* 48:258-61, 1991.

d. Head and Neck Tumors

Most cancers of the head and neck are of a type called carcinoma (in particular squamous cell carcinoma). Carcinomas of the head and neck start in the cells that form the lining of the mouth, nose, throat or ear, or the surface layer covering the tongue. However, cancers of the head and neck can develop from other types of cells. Lymphoma develops from the cells of the lymphatic system. Sarcoma develops from the supportive cells which make up muscles, cartilage or blood vessels. Melanoma starts from cells called melanocytes, which give colour to the eyes and skin. The symptoms of a head and neck cancer will depend on where it is—for example, cancer of the tongue may cause some slurring of speech. The most common symptoms are an ulcer or sore area in the head or neck that does not heal within a few weeks; difficulty in swallowing, or pain when chewing or swallowing; trouble with breathing or speaking, such as persistent noisy breathing, slurred speech or a hoarse voice; a numb feeling in the mouth; a persistent blocked nose, or nose bleeds; persistent earache, ringing in the ear, or difficulty in hearing; a swelling or lump in the mouth or neck; pain in the face or upper jaw; in people who smoke or chew tobacco, pre-cancerous changes can occur in the lining of the mouth, or on the tongue. These can appear as persistent white patches (leukoplakia) or red patches (erythroplakia). They are usually painless but can sometimes be sore and may bleed (Cancerbacup Internet website). The effects of a PDGFRβ and/or VEGF-A antagonist on tumor response can be evaluated in a murine head and neck tumor model similar to that described in Kuriakose et al., *Head Neck* 22:57-63, 2000; Cao et al., *Clin. Cancer Res.* 5:1925-34, 1999; Hier et al., *Laryngoscope* 105:1077-80, 1995; Braakhuis et al., *Cancer Res.* 51:211-4, 1991; Baker, *Laryngoscope* 95:43-56, 1985; and Dong et al., *Cancer Gene Ther.* 10:96-104, 2003.

e. Brain Cancer

Tumors that begin in brain tissue are known as primary tumors of the brain. Primary brain tumors are named according to the type of cells or the part of the brain in which they begin. The most common primary brain tumors are gliomas. They begin in glial cells. There are many types of gliomas. (1) Astrocytoma—The tumor arises from star-shaped glial cells called astrocytes. In adults, astrocytomas most often arise in the cerebrum. In children, they occur in the brain stem, the cerebrum, and the cerebellum. A grade III astrocytoma is sometimes called an anaplastic astrocytoma. A grade IV astrocytoma is usually called a glioblastoma multiforme. (2) Brain stem glioma—The tumor occurs in the lowest part of the brain. Brain stem gliomas most often are diagnosed in young children and middle-aged adults. (3) Ependymoma—The tumor arises from cells that line the ventricles or the central canal of the spinal cord. They are most commonly found in children and young adults. (4) Oligodendroglioma—This rare tumor arises from cells that make the fatty substance that covers and protects nerves. These tumors usually occur in the cerebrum. They grow slowly and usually do not spread into surrounding brain tissue. They are most common in middle-aged adults. The symptoms of brain tumors depend on tumor size, type, and location. Symptoms may be caused when a tumor presses on a nerve or damages a certain area of the brain. They also may be caused when the brain swells or fluid builds up within the skull. These are the most common symptoms of brain tumors: Headaches (usually worse in the morning); Nausea or vomiting; Changes in speech, vision, or hearing; Problems balancing or walking; Changes in mood, personality, or ability to concentrate; Problems with memory; Muscle jerking or twitching (seizures or convulsions); and Numbness or tingling in the arms or legs (National Cancer Institute's Internet website). The effects of a PDGFRβ and/or VEGF-A antagonist on tumor response can be evaluated in a glioma animal model similar to that described in Schueneman et al., *Cancer Res.* 63:4009-16, 2003; Martinet et al., *Eur. J. Surg. Oncol.* 29:351-7, 2003; Bello et al., *Clin. Cancer Res.* 8:3539-48, 2002; Ishikawa et al., *Cancer Sci.* 95:98-103, 2004; Degen et al., *J. Neurosurg.* 99:893-8, 2003; Engelhard et al., *Neurosurgery* 48:616-24, 2001; Watanabe et al., *Neurol. Res.* 24:485-90, 2002; and Lumniczky et al., *Cancer Gene Ther.* 9:44-52, 2002.

f. Thyroid Cancer

Papillary and follicular thyroid cancers account for 80 to 90 percent of all thyroid cancers. Both types begin in the follicular cells of the thyroid. Most papillary and follicular thyroid cancers tend to grow slowly. If they are detected early, most can be treated successfully. Medullary thyroid cancer accounts for 5 to 10 percent of thyroid cancer cases. It arises in C cells, not follicular cells. Medullary thyroid cancer is easier to control if it is found and treated before it spreads to other parts of the body. Anaplastic thyroid cancer is the least common type of thyroid cancer (only 1 to 2 percent of cases). It arises in the follicular cells. The cancer cells are highly abnormal and difficult to recognize. This type of cancer is usually very hard to control because the cancer cells tend to grow and spread very quickly. Early thyroid cancer often does not cause symptoms. But as the cancer grows, symptoms may include: A lump, or nodule, in the front of the neck near the Adam's apple; Hoarseness or difficulty speaking in a normal voice; Swollen lymph nodes, especially in the neck; Difficulty swallowing or breathing; or Pain in the throat or neck (National Cancer Institute's Internet website). The effects of a PDGFRβ and/or VEGF-A antagonist on tumor response can be evaluated in a murine or rat thyroid tumor model similar to that described in Quidville et al., *Endocrinology* 145:2561-71, 2004 (mouse model); Cranston et al., *Cancer Res.* 63:4777-80, 2003 (mouse model); Zhang et al., *Clin Endocrinol (Oxf).* 52:687-94, 2000 (rat model); and Zhang et al., *Endocrinology* 140:2152-8, 1999 (rat model).

g. Liver Cancer

There are two different types of primary liver cancer. The most common kind is called hepatoma or hepatocellular carcinoma (HCC), and arises from the main cells of the liver (the hepatocytes). This type is usually confined to the liver, although occasionally it spreads to other organs. It occurs mostly in people with a liver disease called cirrhosis. There is also a rarer sub-type of hepatoma called Fibrolamellar hepatoma, which may occur in younger people and is not related to previous liver disease. The other type of primary liver cancer is called cholangiocarcinoma or bile duct cancer, because it starts in the cells lining the bile ducts. Most people who develop hepatoma usually also have a condition called cirrhosis of the liver. This is a fine scarring throughout the liver which is due to a variety of causes including infection and heavy alcohol drinking over a long period of time. However, only a small proportion of people who have cirrhosis of the liver develop primary liver cancer. Infection with either the hepatitis B or hepatitis C virus can lead to liver cancer, and can also be the cause of cirrhosis, which increases the risk of developing hepatoma. People who have a rare condition called haemochromatosis, which causes excess deposits of iron in the body, have a higher chance of developing hepatoma. Thus, the PDGFRβ and/or VEGF-A antagonists of the present invention may be used to treat, prevent, inhibit the progression of, delay the onset of, and/or reduce the severity or inhibit at least one of the conditions or symptoms associated with hepatocellular carcinoma. The hepatocellular carcinoma may or may not be associated with an hepatitis (e.g., hepatitis A, hepatitis B, hepatitis C and hepatitis D) infection.

The effects of a PDGFRβ and/or VEGF-A antagonist on tumor response can be evaluated in a hepatocellular carcinoma transgenic mouse model, which includes the overexpression of transforming growth factor-α (TFG-α) alone (Jhappan et al., *Cell,* 61:1137-1146, 1990; Sandgren et al., *Mol. Cell. Biol.,* 13:320-330, 1993; Sandgren et al., *Oncogene* 4:715-724, 1989; and Lee et al., *Cancer Res.* 52:5162: 5170, 1992) or in combination with c-myc (Murakami et al., *Cancer Res.,* 53:1719-1723, 1993), mutated H-ras (Saitoh et al., *Oncogene* 5:1195-2000, 1990), hepatitis B viral genes encoding HbsAg and HBx (Toshkov et al., *Hepatology* 20:1162-1172, 1994; Koike et al., *Hepatology* 19:810-819, 1994), SV40 large T antigen (Sepulveda et al., *Cancer Res.* 49:6108-6117, 1989; Schirmacher et al., *Am. J. Pathol.,* 139:231-241, 1991) and FGF 19 (Nicholes et al., *American Journal of Pathology,* 160:2295-2307, 2002).

h. Lung Cancer

The effects of a PDGFRβ and/or VEGF-A antagonist on tumor response can be evaluated in a human small/non-small cell lung carcinoma xenograft model. Briefly, human tumors are grafted into immunodeficient mice and these mice are treated with a PDGFRβ and/or VEGF-A antagonist alone or in combination with other agents which can be used to demonstrate the efficacy of the treatment by evaluating tumor growth (Nemati et al., *Clin Cancer Res.* 6:2075-86, 2000; and Hu et al., *Clin. Cancer Res.* 10:7662-70, 2004).

2. Endpoints and Anti-tumor Activity for Solid Tumors

While each protocol may define tumor response assessments differently, the RECIST (Response evaluation Criteria in solid tumors) criteria is currently considered to be the recommended guidelines for assessment of tumor response by the National Cancer Institute (see Therasse et al., *J. Natl. Cancer Inst.* 92:205-216, 2000). According to the RECIST criteria tumor response means a reduction or elimination of all measurable lesions or metastases. Disease is generally considered measurable if it comprises lesions that can be accurately measured in at least one dimension as ≥20 mm with conventional techniques or ≥10 mm with spiral CT scan with clearly defined margins by medical photograph or X-ray, computerized axial tomography (CT), magnetic resonance imaging (MRI), or clinical examination (if lesions are superficial). Non-measurable disease means the disease comprises of lesions<20 mm with conventional techniques or <10 mm with spiral CT scan, and truly non-measurable lesions (too small to accurately measure). Non-measureable disease includes pleural effusions, ascites, and disease documented by indirect evidence.

The criteria for objective status are required for protocols to assess solid tumor response. Representative criteria include the following: (1) Complete Response (CR), defined as complete disappearance of all measurable disease; no new lesions; no disease related symptoms; no evidence of non-measurable disease; (2) Partial Response (PR) defined as 30% decrease in the sum of the longest diameter of target lesions (3) Progressive Disease (PD), defined as 20% increase in the sum of the longest diameter of target lesions or appearance of any new lesion; (4) Stable or No Response, defined as not qualifying for CR, PR, or Progressive Disease. (See Therasse et al., supra.)

Additional endpoints that are accepted within the oncology art include overall survival (OS), disease-free survival (DFS), objective response rate (ORR), time to progression (TTP), and progression-free survival (PFS) (see *Guidance for Industry: Clinical Trial Endpoints for the Approval of Cancer Drugs and Biologics*, April 2005, Center for Drug Evaluation and Research, FDA, Rockville, Md.)

3. Combination Cancer Therapy

As previously discussed, in certain embodiments, a PDGFRβ and/or VEGF-A antagonist is used in combination with a second agent for treatment of a neovascular disorder. When used for treating cancer, antagonists of the present invention may be used in combination with conventional cancer therapies such as, e.g., surgery, radiotherapy, chemotherapy, or combinations thereof. In certain aspects, other therapeutic agents useful for combination cancer therapy with a PDGFRβ and/or VEGF-A antagonist include other anti-angiogenic agents. In some other aspects, other therapeutic agents useful for combination therapy with a PDGFRβ and/or VEGF-A antagonist include an antagonist of other factors that are involved in tumor growth such as, for example, EGFR, ErbB2 (Her2), ErbB3, ErbB4, or TNF. In some aspects, a PDGFRβ and/or VEGF-A antagonist is co-administered with a cytokine (e.g., a cytokine that stimulates an immune response against a tumor). Exemplary combination therapies particularly amenable for treatment of cancer are described in further detail below.

a. Antibodies Targeting Tumor-associated Antigens in Combination with PDGFRβ and/or VEGF-A Antagonist Antibody therapy has been particularly successful in cancer treatment because certain tumors either display unique antigens, lineage-specific antigens, or antigens present in excess amounts relative to normal cells. One of the mechanisms associated with the anti-tumor activity of monoclonal antibody therapy is antibody dependent cellular cytotoxicity (ADCC). In ADCC, monoclonal antibodies bind to a target cell (e.g., cancer cell) and specific effector cells expressing receptors for the monoclonal antibody (e.g., NK cells, monocytes, granulocytes) bind the monoclonal antibody/target cell complex resulting in target cell death. In certain variations of the present invention, a PDGFRβ and/or VEGF-A antagonist is co-administered with a monoclonal antibody against a tumor-associated antigen. The dose and schedule of the MAbs is based on pharmacokinetic and toxicokinetic properties ascribed to the specific antibody co-administered, and should optimize these effects, while minimizing any toxicity that may be associated with administration of a PDGFRβ and/or VEGF-A antagonist.

Combination therapy with a PDGFRβ and/or VEGF-A antagonist and a monoclonal antibody against a tumor-associated antigen may be indicated when a first line treatment has failed and may be considered as a second line treatment. The present invention also provides using the combination as a first line treatment in patient populations that are newly diagnosed and have not been previously treated with anticancer agents ("de novo patients") and patients that have not previously received any monoclonal antibody therapy ("naïve patients").

A PDGFRβ and/or VEGF-A antagonist is also useful in combination therapy with monoclonal antibodies against tumor-associated antigens in the absence of any direct antibody-mediated ADCC of tumor cells. For example, antibodies that block an inhibitory signal in the immune system can lead to augmented immune responses. Examples include (1) antibodies against molecules of the B7R family that have inhibitory function such as, cytotoxic T lymphocyte-associated antigen 4 (CTLA-4), programmed death-1 (PD-1), B and T lymphocyte attenuator (BTLA); (2) antibodies against inhibitory cytokines like IL-10, TGFβ; and (3) antibodies that deplete or inhibit functions of suppressive cells like anti-CD25 or CTLA-4. For example, anti-CTLA4 MAbs in both mice and humans are thought to either suppress function of immune-suppressive regulatory T cells (Tregs) or inhibit the inhibitory signal transmitted through binding of CTLA-4 on T cells to B7-1 or B7-2 molecules on APCs or tumor cells.

Table 8 is a non-exclusive list of monoclonal antibodies approved or being tested for which combination therapy with a PDGFRβ and/or VEGF-A antagonist is possible.

TABLE 8

Monoclonal Antibody Therapies for Use in Combination with PDGFRβ and/or VEGF-A Antagonists

| Target | Drug Name | Clinical Indication | Company |
|---|---|---|---|
| TRAIL-R1 | HGS-ETR1 | cancers | HGS |
| TRAIL-R2 | HGS-ETR2 | solid tumors | HGS |
| CD40 | SGN40 | MM | Seattle Genetics |
| HER2 | Herceptin | Breast cancer | Genentech |
| EGF-R | ABX-EGF | CRC, NSCLC, RCC | Abgenix |
| EGF-R | EMD72000 | solid tumors | Merck |
| EGF-R | MDX-214 | EGF-R-positive tumors | Medarex |
| EGF-R | Erbitux | CRC | Imclone |
| α5β3 integrin | Vitaxin | psoriasis, prostate cancer | AME/Lilly |
| CD152 | CTLA-4 | cancers | Medarex |
| CD49e | Integrin α5 | cancers | Protein Design Labs |
| MUC18 (TIM-like) | ABX-MA1 | melanoma | |

TABLE 8-continued

Monoclonal Antibody Therapies for Use in Combination with PDGFRβ and/or VEGF-A Antagonists

| Target | Drug Name | Clinical Indication | Company |
|---|---|---|---|
| TAG-72 Mucin | Anatumomab | cancers | |
| CD3 | Ecromeximab | melanoma | Kyowa Hakko |
| CD64 (Fc GR1) | AntiCD64 | cancers | Medarex |
| CEA | CEA-Cide | cancers | Immunomedics |
| EpCAM | Panorex | colorectal cancer | Centocor |
| Lewis-Y-Ag | SGN15 | cancers | Seattle Genetics | b. Tyrosine Kinase Inhibitors in Combination with PDGFRβ and/or VEGF-A Antagonist In some embodiments, a PDGFRβ and/or VEGF-A antagonist as described herein is used in combination with a tyrosine kinase inhibitor. Tyrosine kinases are enzymes that catalyze the transfer of the γ phosphate group from the adenosine triphosphate to target proteins. Tyrosine kinases can be classified as receptor and nonreceptor protein tyrosine kinases. They play an essential role in diverse normal cellular processes, including activation through growth receptors and affect proliferation, survival and growth of various cell types. Additionally, they are thought to promote tumor cell proliferation, induce anti-apoptotic effects and promote angiogenesis and metastasis. In addition to activation through growth factors, protein kinase activation through somatic mutation is a common mechanism of tumorigenesis. Some of the mutations identified are in B-Raf kinase, FLt3 kinase, BCR-ABL kinase, c-KIT kinase, epidermal growth factor (EGFR) and PDGFR pathways. The Her2, VEGFR and c-Met are other significant receptor tyrosine kinase (RTK) pathways implicated in cancer progression and tumorigenesis. Because a large number of cellular processes are initiated by tyrosine kinases, they have been identified as key targets for inhibitors.

Tyrosine kinase inhibitors (TKIs) are small molecules that act inside the cell, competing with adenosine triphosphate (ATP) for binding to the catalytic tyrosine kinase domain of both receptor and non-receptor tyrosine kinases. This competitive binding blocks initiation of downstream signaling leading to effector functions associated with these signaling events like growth, survival, and angiogenesis. Using a structure and computational approach, a number of compounds from numerous medical chemistry combinatorial libraries was identified that inhibit tyrosine kinases.

Most TKIs are thought to inhibit growth of tumors through direct inhibition of the tumor cell or through inhibition of angiogenesis. Moreover, certain TKIs affect signaling through the VEGF family receptors, including sorafenib and sunitinib. In some cases TKIs have been shown to activate functions of dendritic cells and other innate immune cells, like NK cells. This has been recently reported in animal models for imatinib. Imatinib is a TKI that has shown to enhance killer activity by dendritic cells and NK cells (for review, see Smyth et al., NEJM 354:2282, 2006).

BAY 43-9006 (sorafenib, Nexavar®) and SU11248 (sunitinib, Sutent®) are two such TKIs that have been recently approved for use in metastatic renal cell carcinoma (RCC). A number of other TKIs are in late and early stage development for treatment of various types of cancer. Other TKIs include, but are not limited to: Imatinib mesylate (Gleevec®, Novartis); Gefitinib (Iressa®, AstraZeneca); Erlotinib hydrochloride (Tarceva®, Genentech); Vandetanib (Zactima®, AstraZeneca), Tipifarnib (Zarnestra®, Janssen-Cilag); Dasatinib (Sprycel®, Bristol Myers Squibb); Lonafarnib (Sarasar®, Schering Plough); Vatalanib succinate (Novartis, Schering AG); Lapatinib (Tykerb®, GlaxoSmithKline); Nilotinib (Novartis); Lestaurtinib (Cephalon); Pazopanib hydrochloride (GlaxoSmithKline); Axitinib (Pfizer); Canertinib dihydrochloride (Pfizer); Pelitinib (National Cancer Institute, Wyeth); Tandutinib (Millennium); Bosutinib (Wyeth); Semaxanib (Sugen, Taiho); AZD-2171 (AstraZeneca); VX-680 (Merck, Vertex); EXEL-0999 (Exelixis); ARRY-142886 (Array BioPharma, AstraZeneca); PD-0325901 (Pfizer); AMG-706 (Amgen); BIBF-1120 (Boehringer Ingelheim); SU-6668 (Taiho); CP-547632 (OSI); (AEE-788 (Novartis); BMS-582664 (Bristol-Myers Squibb); JNK-401 (Celgene); R-788 (Rigel); AZD-1152 HQPA (AstraZeneca); NM-3 (Genzyme Oncology); CP-868596 (Pfizer); BMS-599626 (Bristol-Myers Squibb); PTC-299 (PTC Therapeutics); ABT-869 (Abbott); EXEL-2880 (Exelixis); AG-024322 (Pfizer); XL-820 (Exelixis); OSI-930 (OSI); XL-184 (Exelixis); KRN-951 (Kirin Brewery); CP-724714 (OSI); E-7080 (Eisai); HKI-272 (Wyeth); CHIR-258 (Chiron); ZK-304709 (Schering AG); EXEL-7647 (Exelixis); BAY-57-9352 (Bayer); BIBW-2992 (Boehringer Ingelheim); AV-412 (AVEO); YN-968D1 (Advenchen Laboratories); Midostaurin (Novartis); Perifosine (AEterna Zentaris, Keryx, National Cancer Institute); AG-024322 (Pfizer); AZD-1152 (AstraZeneca); ON-01910Na (Onconova); and AZD-0530 (AstraZeneca).

c. Chemotherapy Combinations

In certain embodiments, a PDGFRβ and/or VEGF-A antagonist is administered in combination with one or more chemotherapeutic agents. Chemotherapeutic agents have different modes of actions, for example, by influencing either DNA or RNA and interfering with cell cycle replication. Examples of chemotherapeutic agents that act at the DNA level or on the RNA level are anti-metabolites (such as Azathioprine, Cytarabine, Fludarabine phosphate, Fludarabine, Gemcitabine, cytarabine, Cladribine, capecitabine 6-mercaptopurine, 6-thioguanine, methotrexate, 5-fluoroouracil and hyroxyurea); alkylating agents (such as Melphalan, Busulfan, Cis-platin, Carboplatin, Cyclophosphamide, Ifosphamide, Dacarabazine, Procarbazine, Chlorambucil, Thiotepa, Lomustine, Temozolamide); anti-mitotic agents (such as Vinorelbine, Vincristine, Vinblastine, Docetaxel, Paclitaxel); topoisomerase inhibitors (such as Doxorubincin, Amsacrine, Irinotecan, Daunorubicin, Epirubicin, Mitomycin, Mitoxantrone, Idarubicin, Teniposide, Etoposide, Topotecan); antibiotics (such as actinomycin and bleomycin); asparaginase; anthracyclines or taxanes.

d. Radiotherapy Combinations

In some variations, a PDGFRβ and/or VEGF-A antagonist is administered in combination with radiotherapy. Certain tumors can be treated with radiation or radiopharmaceuticals. Radiation therapy is generally used to treat unresectable or inoperable tumors and/or tumor metastases.

Radiotherapy is typically delivered in three ways. External beam irradiation is administered at distance from the body and includes gamma rays ($^{60}$Co) and X-rays. Brachytherapy uses sources, for example $^{60}$Co, $^{137}$Cs, $^{192}$Ir, or $^{125}$I, with or in contact with a target tissue.

e. Hormonal Agent Combinations

In some embodiments, a PDGFRβ and/or VEGF-A antagonist is administered in combination with a hormone or anti-hormone. Certain cancers are associated with hormonal dependency and include, for example, ovarian cancer, breast cancer, and prostate cancer. Hormonal-dependent cancer treatment may comprise use of anti-androgen or anti-estrogen compounds. Hormones and anti-hormones used in cancer therapy include Estramustine phosphate, Polyestradiol phosphate, Estradiol, Anastrozole, Exemestane, Letrozole, Tamoxifen, Megestrol acetate, Medroxyprogesterone acetate, Octreotide, Cyproterone acetate, Bicaltumide, Flutamide, Tritorelin, Leuprorelin, Buserelin and Goserelin.

C. Neovascular Ocular Disorders

Several ocular disorders involve alterations in angiogenesis and are amenable to treatment in accordance with the present invention. Such neovascular ocular disorders include, for example, age-related macular degeneration (e.g., "wet" age-related macular degeneration), diabetic retinopathy, iris neovascularization, neovascular glaucoma, proliferative vitroretinopathy, optic disc neovascularization, corneal neovascularization, vitreal neovascularization, pannus, pterygium, macular edema, diabetic macular edema, vascular retinopathy, retinal degeneration, uveitis, and inflammatory diseases of the retina.

For example, diabetic retinopathy, the third leading cause of adult blindness (accounting for almost 7% of blindness in the USA), is associated with extensive angiogenic events. Nonproliferative retinopathy is accompanied by the selective loss of pericytes within the retina, and their loss results in dilation of associated capillaries dilation and a resulting increase in blood flow. In the dilated capillaries, endothelial cells proliferate and form outpouchings, which become microaneurysms, and the adjacent capillaries become blocked so that the area of retina surrounding these microaneurysms is not perfused. Eventually, shunt vessels appear between adjacent areas of micro aneurysms, and the clinical picture of early diabetic retinopathy with micro aneurysms and areas of nonperfused retina is seen. The microaneurysms leak and capillary vessels may bleed, causing exudates and hemorrhages. Once the initial stages of background diabetic retinopathy are established, the condition progresses over a period of years, developing into proliferative diabetic retinopathy and blindness in about 5% of cases. Proliferative diabetic retinopathy occurs when some areas of the retina continue losing their capillary vessels and become nonperfused, leading to the appearance of new vessels on the disk and elsewhere on the retina. These new blood vessels grow into the vitreous and bleed easily, leading to preretinal hemorrhages. In advanced proliferative diabetic retinopathy, a massive vitreous hemorrhage may fill a major portion of the vitreous cavity. In addition, the new vessels are accompanied by fibrous tissue proliferation that can lead to traction retinal detachment.

Diabetic retinopathy is associated primarily with the duration of diabetes mellitus; therefore, as the population ages and diabetic patients live longer, the prevalence of diabetic retinopathy will increase. Laser therapy is currently used in both nonproliferative and proliferative diabetic retinopathy. Focal laser treatment of the leaking microaneurysms surrounding the macular area reduces visual loss in 50% of patients with clinically significant macular edema. In proliferative diabetic retinopathy, panretinal photocoagulation results in several thousand tiny burns scattered throughout the retina (sparing the macular area); this treatment reduces the rate of blindness by 60 percent. Early treatment of macular edema and proliferative diabetic retinopathy prevents blindness for 5 years in 95% of patients, whereas late treatment prevents blindness in only 50 percent. Therefore, early diagnosis and treatment are essential.

Another ocular disorder involving neovascularization is age-related macular degeneration (AMD), a disease that affects approximately one in ten Americans over the age of 65. AMD is characterized by a series of pathologic changes in the macula, the central region of the retina, which is accompanied by decreased visual acuity, particularly affecting central vision. AMD involves the single layer of cells called the retinal pigment epithelium that lies immediately beneath the sensory retina. These cells nourish and support the portion of the retina in contact withthem, i.e., the photoreceptor cells that contain the visual pigments. The retinal pigment epithelium lies on the Bruch membrane, a basement membrane complex which, in AMD, thickens and becomes sclerotic. New blood vessels may break through the Bruch membrane from the underlying choroid, which contains a rich vascular bed. These vessels may in turn leak fluid or bleed beneath the retinal pigment epithelium and also between the retinal pigment epithelium and the sensory retina. Subsequent fibrous scarring disrupts the nourishment of the photoreceptor cells and leads to their death, resulting in a loss of central visual acuity. This type of age-related maculopathy is called the "wet" type because of the leaking vessels and the subretinal edema or blood. The wet type accounts for only 10% of age-related maculopathy cases but results in 90% of cases of legal blindness from macular degeneration in the elderly. The "dry" type of age-related maculopathy involves disintegration of the retinal pigment epithelium along with loss of the overlying photoreceptor cells. The dry type reduces vision but usually only to levels of 20/50 to 20/100.

AMD is accompanied by distortion of central vision with objects appearing larger or smaller or straight lines appearing distorted, bent, or without a central segment. In the wet type of AMD, a small detachment of the sensory retina may be noted in the macular area, but the definitive diagnosis of a subretinal neovascular membrane requires fluorescein angiography. In the dry type, drusen may disturb the pigmentation pattern in the macular area. Drusen are excrescences of the basement membrane of the retinal pigment epithelium that protrude into the cells, causing them to bulge anteriorly; their role as a risk factor in age-related maculopathy is unclear. No treatment currently exists for the dry type of age-related maculopathy. Conventional treatments for the wet type of age-related maculopathy include laser treatment, which initially obliterates the neovascular membrane and prevents further visual loss in about 50% of patients at 18 months. By 60 months, however, only 20% still have a substantial benefit.

For pharmaceutical use in treating a neovascular ocular disorder, a PDGFRβ and/or VEGF-A antagonist are typically formulated for intravitreal injection according to conventional methods. In general, pharmaceutical formulations will include the antagonist(s) in combination with a pharmaceutically acceptable vehicle, such as saline, buffered saline, 5% dextrose in water, or the like. In certain variations for ophthalmic uses, a PDGFRβ and/or VEGF-A antagonist is formulated in a phosphate buffered saline at pH 5-7.

Suppression of a neovascular ocular disorder is evaluated by any accepted method of measuring whether angiogenesis is slowed or diminished. This includes direct observation and indirect evaluation such as by evaluating subjective symptoms or objective physiological indicators.

Treatment efficacy, for example, may be evaluated based on the prevention or reversal of neovascularization, microangiopathy, vascular leakage or vascular edema, or any combination thereof. Treatment efficacy for evaluating suppression of an ocular neovascular disorder may also be defined in terms of stabilizing or improving visual acuity.

In determining the effectiveness of a particular therapy in treating or preventing an neovascular ocular disorder, patients may also be clinically evaluated by an ophthalmologist several days after injection and at least one-month later just prior to the next injection. ETDRS visual acuities, kodachrome photography, and fluorescein angiography are also performed monthly for the first 4 months as required by the ophthalmologist.

For example, in order to assess the effectiveness of PDGFRβ antagonist and/or VEGF-A antagonist therapy to treat ocular neovascularization, studies may be conducted involving the administration of either single or multiple intravitreal injections of a PDGFRβ antagonist and/or VEGF-A antagonist in patients suffering from subfoveal choroidal neovascularization secondary to age-related macular degeneration according to standard methods well known in the ophthalmologic arts. In one exemplary study, patients with subfoveal choroidal neovascularization (CNV) secondary to age-related macular degeneration (AMD) receive a single intravitreal injection of a PDGFRβ and/or VEGF-A antagonist. Effectiveness of the treatment is monitored, for example, by ophthalmic evaluation. Patients showing stable or improved vision three months after treatment, for example, demonstrating a 3-line or greater improvement in vision on the ETDRS chart, are taken as receiving an effective dosage of the PDGFRβ antagonist and/or VEGF-A antagonist that suppresses an ocular neovascular disorder.

The invention is further illustrated by the following non-limiting examples.

EXAMPLE 1

Panning for Antibodies that Bind VEGF-A

Antibodies that bind to VEGF-A were identified by screening the Dyax Fab 310 phage library (Dyax Corp., Cambridge, Mass.). The chosen method for selection and screening of the phage-antibody libraries utilized polystyrene immunotubes (NUNC, Denmark) coated with antigen (VEGF-$A_{165}$, R&D Systems). The antibodies were isolated by increasing the stringency after a few rounds of selection. The first generation of antibodies was in the Fab format. The soluble Fab antibodies were generated by MluI (#R0198S, New England Biolabs, Beverly, Mass.) enzyme digestion to remove the geneIII stump from M13 phage. The same strategy of selection, screening, and solubilizing was applied for antibodies in the scFv format.

EXAMPLE 2

Identification of VEGF-A-binding Fab Clones

Fab clones binding VEGF-A were identified by a plate based binding assay. Costar (#9018) 96-well plates were coated with 50 µl VEGF-A (R&D Systems) or PDGF-D (SEQ ID NO:481) homodimer at 0.6 µg/ml in 0.1M NaHCO$_3$, pH 9.6 overnight at 4° C. The next day, plates were washed three times with 0.1% Tween-20/PBS (PBST). Each well was filled with 100 µl of 2% milk (#170-6404, Bio-Rad)/PBST for one hour at RT for blocking. Assay plates were then washed three times with PBST. Each well was filled with 25 ul of 2% milk/PBST, followed by the addition of 25 ul of Fab supernatant. Wells were then mixed and incubated for one hour at RT. Plates were washed three times with PBST. For Fab detection, 50 ul of (1:4000) anti-Human Fab specific pAb-HRP (#31482, Pierce) in 2% milk/PBST was added to each well for one hour at RT. Plates were then washed three times with PBST. 50 ul of TMB (TMBW-1000-01, BioFX Laboratories) was added to each well to develop for 15 min, followed by the addition of 50 ul of stop buffer (STPR-1000-01, BioFX Laboratories) to quench the reaction. Plates were then read at 450 nm on a plate reader.

EXAMPLE 3

Conversion of VEGF-A-binding sFab into scFv

Lambda, kappa, and heavy chain variable regions were amplified from a pool of round 2, Arm A and Arm B VEGF-A-panned Fab Dyax phage DNA in a 3 step process using primers directed against framework sequences for each subtype. The first round PCR amplifies each of the variable framework regions and adds appropriate overhangs to facilitate round 2 PCR reactions. Round 2 PCR reactions add appropriate gly/ser linker sequences to the ends of the proper round 1 PCR products and round 3 PCR reactions overlap the variable light chain lambda, variable light chain kappa, and variable heavy chain products to create scFv products in both LH and HL orientations, which were then cloned into ApaLI/NotI-digested PIMD21 phage display vector.

EXAMPLE 4

Identification sFabs and scFvs that Inhibit VEGF Binding to sVEGFR2

VEGF-A Fab and scFv clones were screened by a plate-based neutralization assay. Costar (#9018) 96-well plates were coated with 100 µl of anti-human IgG Fcγ-specific antibody (#109-005-098, Jackson Immunology) at 1 µg/ml in 0.1 M NaHCO$_3$, pH 9.6 overnight at 4° C. The next day, plates were washed three times with 400 ul 0.1% Tween-20/PBS (PBST). Each well was filled with 100 µl of 1% BSA (#A3059-100G, SIGMA)/PBST for one hour at room temperature (RT) for blocking. Plates were washed three times with PBST. 100 µl of VEGFR2-Fc (SEQ ID NO:482) at 0.2 µg/ml in 1% BSA/PBST was added to each well for one hour at room temperature. Concurrently, in a separate 96 well plate (Costar 3357), 65 µl of Fab or scFv supernatant was added to 65 µl of biotinylated VEGF-A in 1% BSA/PBST at 20 ng/ml for 1 hr at room temperature. Blocked assay plates were washed three times with PBST. Each well was filled with 100 µl of supernatant/biotinylated VEGF-A complex for 1 hr at room temperature. Plates were washed three times with PBST. 100 µl of (1:4000) Streptavidin-HRP (#21124, Pierce) in 1% BSA/PBST was added to each well for one hour at room temperature. Plates were then washed three times with PBST. 100 µl of TMB (TMBW-1000-01, BioFX Laboratories) was added to each well to develop for 20 minutes, followed by the addition of 100 µl of stop buffer (STPR-1000-01, BioFX Laboratories) to quench the reaction. Plates were then read at 450 nm on a plate reader.

EXAMPLE 5

Measurement of Binding Affinities of Human VEGF Receptor-2 to the Human VEGF-A Via Surface Plasmon Resonance (Biacore)

Affinity Determination

Kinetic rate constants and equilibrium dissociation constants were measured for the interaction of VEGF Receptor-2 (VEGFR-2) with the VEGF-A via surface plasmon resonance. Surface plasmon resonance allows monitoring of both association and dissociation phases during biomolecular interactions (Ohlson, J Mol Recognit, 1997). The association rate constant ($k_a$ ($M^{-1}s^{-1}$)) is a value that reflects the rate of the antigen-antagonist complex formation. The dissociation rate constant ($k_d$ ($s^{-1}$)) is a value that reflects the stability of this complex. By dividing the association rate constant by the dissociation rate constant ($k_a/k_d$) the equilibrium association constant ($K_A$ ($M^{-1}$)) is obtained. By dividing the dissociation rate constant by the association rate constant ($k_d/k_a$) the equilibrium dissociation constant ($K_D$ (M)) is obtained. This value describes the binding affinity of the interaction. Interactions with the same $K_D$ can have widely variable association and dissociation rate constants. Consequently, measuring both the $k_a$ and $k_d$ helps to more accurately describe the affinity of the interaction.

Materials and Methods

A series of experiments were completed to measure the binding affinity of VEGFR-2 interaction with VEGF-A. Binding kinetics and affinity measurements were obtained using surface plasmon resonance assays using a Biacore T100™ system (GE Healthcare, Piscataway, N.J.). Methods, were programmed using Biacore T100™ Control Software, v 1.1.1. Human VEGF-A (R&D Systems) was covalently immobilized onto the CM5 sensor chip using amine coupling chemistry (EDC:NHS) to a density of approximately 200 RU. After the immobilization, remaining active sites on the flow cell were blocked with ethanolamine. Non-specific bound protein was removed by washing with 50 mM NaOH. A reference flow cell was activated and then blocked with ethanolamine.

Serial 1:2 dilutions of human VEGFR-2-Fc5 ranging from 200 nM to 3.13 nM were injected over the surface and allowed to specifically bind to the VEGF-A immobilized on the sensor chip. Injections of the VEGFR-2-Fc5 concentrations were performed with an association time of 10 minutes and dissociation time of 15 minutes. Kinetic binding studies were performed with a flow rate of 30 μl/min. All binding experiments were performed at 25° C. in a buffer of 10 mM HEPES, 150 mM NaCl, 3 mM EDTA 0.05% Surfactant P20, pH 7.4. Buffer injections were also performed to allow for subtraction of instrument noise and drift. Between cycles, the flow cell was washed with 10 mM Glycine, pH 1.5 to regenerate the surface. Baseline stability was assessed to ensure that the regeneration step provided a consistent binding surface throughout the sequence of injections.

Data was compiled using Biacore T100™ Evaluation software (version 1.1.1). Data was processed by subtracting reference flow cell and blank injections and baseline stability was assessed to ensure that the regeneration step provided a consistent binding surface throughout the sequence of injections. Duplicate injection curves were checked for reproducibility. Because VEGFR-2-Fc5 and VEGF-A are both dimeric molecules, the bivalent analyte model was determined to be the most appropriate and the resulting binding curves were globally fitted to this model.

Results

VEGFR-2 was characterized for its binding affinity for VEGF-A (results summarized in Table 9). Association rate constants ($k_a$ ($M^{-1}s^{-1}$)) and dissociation rate constants ($k_d$ ($s^{-1}$)) were measured. The data fit well to the bivalent interaction model. This model measures two values for both $k_a$ ($k_{a1}$ and $k_{a2}$) and for $k_d$ ($k_{d1}$ and $k_{d2}$). The first set of values ($k_{a1}$ and $k_{d1}$) describes the monovalent kinetics of the interaction which are reported in Table 9. The affinity reported for these samples was derived from these values, and is designated $K_{D1}$. $K_D$ and $K_A$ were calculated from the $k_a$ and $k_d$ values. Under these assay conditions, equilibrium dissociation rate constant for VEGF-A/VEGFR-2 interaction was approximately $1.E^{-8}$M.

TABLE 9

Characterization of VEGF-A Binding Affinity for VEGFR-2

| Interaction | $k_a$ ($M^{-1}s^{-1}$) | $k_d$ ($s^{-1}$) | $K_D$ (M) | $K_A$ ($M^{-1}$) |
|---|---|---|---|---|
| VEGF-A VEGFR-2 | 2.E+4 | 2.E−4 | 1.E−8 | 1.E+8 |

EXAMPLE 6

Measurement of Dissociation Rate Constants of Interaction of Human VEGF-A Antagonists with Human VEGF-A via Surface Plasmon Resonance (Biacore)

Human VEGF-A antagonists were evaluated for their binding affinity to human VEGF-A according to their dissociation rate constants using surface plasmon resonance. Dissociation rate constants were measured for the interaction of VEGF-A antagonists with VEGF-A via surface plasmon resonance. The dissociation rate constant ($k_d$($s^{-1}$)) is a value that reflects the stability of this complex. It is independent of the concentration and therefore suitable for screening and ranking samples with unknown concentrations.

Materials and Methods

A series of experiments were completed to measure the binding affinity of VEGF-A antagonists to VEGF-A. Binding kinetics and affinity studies were performed on a Biacore T-100™ system (GE Healthcare, Piscataway, N.J.). Methods were programmed using Biacore T100™ Control Software, v 1.1.1. Human VEGF-A was covalently immobilized on a CM5 sensor chip using amine coupling chemistry (EDC:NHS) to a density of approximately 200 RU. VEGF-A was immobilized only to the active flow cell. After the immobilization procedure, remaining active sites on the flow cell were blocked with ethanolamine. Non-specifically bound protein was removed by washing with 50 mM NaOH. A reference cell was activated and then blocked with ethanolamine.

The VEGF-A antagonist supernatants (selected from a Dyax phage library screening) were diluted 1:3 in running buffer, injected over the surface and allowed to specifically bind to VEGF-A on a sensor chip with an association time of 5 minutes and dissociation time of 5 minutes. Duplicate injections of 100 nM VEGFR-2-Fc5 and 100 nM anti-VEGF-A monoclonal antibody (Avastin™, Genentech) were used as positive controls. Kinetic binding studies were performed using a flow rate of 30 ul/min. All binding experiments were performed at 25° C. in running buffer of 10 mM HEPES, 150 mM NaCl, 3 mM EDTA 0.05% Surfactant P20, 1 mg/ml bovine serum albumin, pH 7.4. Buffer injections were also performed to allow for subtraction of instrument noise and drift. Between cycles, the flow cell was washed with 10 mM Glycine, pH 1.5 to remove bound VEGF-A antagonists from the surface.

Data was compiled using Biacore T100™ Evaluation software (version 1.1.1). Data was processed by subtracting reference flow cell and blank injections. Baseline stability was assessed to ensure that the regeneration step provided a consistent binding surface throughout the sequence of injections. Since the starting concentrations of the VEGF-A antagonists were unknown, resulting binding curves were globally fit to a 1:1 dissociation binding model to calculate the dissociation rate constants ($k_d$ ($s^{-1}$)).

Results

Dissociation rate analysis of VEGF-A antagonists to human VEGF-A was determined. Resulting binding curves fit well to a 1:1 dissociation model. The starting concentrations of the VEGF-A antagonists were unknown, therefore only dissociation rate constants ($k_d$ ($s^{-1}$)) were reported since $k_d$ is independent of concentration. Calculated dissociation rate constants were ranked from slowest to fastest. Under these assay conditions, the VEGF-A antagonists display a large range of dissociation rate constants ($1.E^{-5}$-$2.E^{-2}$ ($s^{-1}$)) for their interaction to VEGF-A (see Table 10). For comparison, the $k_d$ of VEGFR-2-Fc5-VEGF-A interaction was approximately $2.E^{-4}$ $s^{-1}$ and anti-VEGF-A monoclonal antibody Avastin™ Fab-VEGF-A interaction was approximately $8.E^{-5}$ $s^{-1}$.

TABLE 10

Dissociation Rate Constants of Interaction of VEGF-A Antagonists with VEGF-A

| scFvs and controls | Off-rate [$k_d$ ($s^{-1}$)] |
| --- | --- |
| Avastin ™ | 1.E−04 |
| Lucentis ™ | 2.E−05 |
| Avastin ™ Fab | 8.E−05 |
| c636.1_1 | 2.E−04 |
| c721.1_1 | 2.E−04 |
| c721.1_2 | 2.E−04 |
| c752.1_1 | 5.E−04 |
| c831.1_1 | 4.E−04 |
| c1036.1_1 | 5.E−04 |
| c1044.1_1 | 3.E−04 |
| c1090.1_1 | 3.E−04 |
| c1094.1_1 | 4.E−04 |
| c1155.1_1 | 4.E−04 |
| c1080.1_1 | 2.E−03 |
| c1135.1_1 | 5.E−04 |
| c1270.1_1 | 5.E−04 |
| c1285.1_1 | 6.E−04 |
| c1257.1_1 | 5.E−04 |
| c1410.1_1 | 2.E−04 |
| c1476.1_1 | 2.E−04 |
| c641.1_1 | 7.E−04 |
| c648.1_1 | 5.E−04 |
| c868.1_1 | 6.E−04 |
| c870.1_1 | 2.E−04 |
| c1039.1_1 | 2.E−04 |
| c1092.1_1 | 4.E−03 |

EXAMPLE 7

Purification of Proteins Derived from *E. coli* Periplasmic Fraction scFv, tandem scFv, and sFab proteins were expressed in the periplasmic space of *E. coli* cells. Scale of ferment ranged from 25 mL shake flask cultures to 2 L batch fed systems. *E. coli* cells were spun down using a centrifuge into a pellet. Wet cell pellet was completely re-suspended in periplasting buffer [0.2 M Tris, 20% (w/v) sucrose, Complete EDTA-free protease inhibitor cocktail (Roche) pH 7.5] at a ratio of 2 mL per gram of wet cell weight. Lysozyme, an enzyme that facilitates the degradation of the cell wall may or may not be included in the procedure. To determine whether or not to use lysozyme, 500 uL of re-suspended pellet was transferred to an eppendorf tube and 30 U of Ready-Lyse lysozyme (Epicentre) per uL of periplasting buffer used was added and the suspension incubated at room temperature for 5 minutes. After the incubation, the solution was checked for increased viscosity by inversion. If the solution clings to the wall of the tube, then premature cell lysis may be occurring, and the lysozyme is not included in the preparative solution. If the solution does not cling to the tube wall, then the lysozyme is included in the preparative solution. If using lysozyme, 30 U of Ready-Lyse lysozyme (Epicentre) per uL of periplasting buffer used was added and the suspension incubated at room temperature for 4-6 minutes. Ice cold water was added at a ratio of 3 mL per gram of original wet cell pellet weight and the solution incubated for at least 10 minutes but no longer than 30 minutes. The remaining spheroplasts were pelleted via centrifugation at 15,000×g (or 10,000-20,000 RPM, whichever is faster) for at least 15 minutes, but no longer than 45 minutes, at room temperature. The supernatant containing the periplasmic fraction was poured into a new vessel and adjusted to 25 mM Imidazole, 500 mM NaCl using weighed out solid. This solution was filtered through a 0.22 um filter prior to purification using a bottle top filter (Nalgene).

Immobilized Metal Affinity Chromatography (IMAC) Capture

Traditionally, a 5 mL HisTrap HP column (GE Healthcare) was used for the IMAC step, however, the column size can be scaled up or down depending on the amount of scFv target in the periplasmic fraction as determined by an analytical IMAC-SEC assay. Binding capacity of this IMAC resin has been shown to be at least 20 mg/mL of packed bed. If using columns larger than 10 mL in size, Waters Glass Columns (Millipore) with a 2 and 5 cm internal diameter were preferred. Using an appropriate chromatography station (Akta Explorer using UNICORN software 4.1 and higher [GE Healthcare] or BioCAD Sprint, 700E, or Vision using Perfusion Chromatography software version 3.00 or higher [Applied Biosystems]), the IMAC column was equilibrated in 50 mM $NaPO_4$, 500 mM NaCl, 25 mM Imidazole pH 7.5 and the periplasmic fraction loaded over it at no faster than 190 cm/hr until depleted. Column was washed with equilibration buffer until monitors at UV A254 nm and UV A280 nm are baseline stable for at least 2 CV at a flow rate not to exceed 190 cm/hr. Bound protein was eluted competitively using 50 mM $NaPO_4$, 500 mM NaCl, 400 mM Imidazole, pH 7.5 at no faster than 190 cm/hr. Elution fractions were assessed for protein content via UV @ A280 nm, analytical size exclusion chromatography, and SDS-PAGE.

Other Chromatographic Techniques

Purity of the IMAC pool was assessed by SDS-PAGE gel and analytical size exclusion chromatography (SEC). If the pool was not amenable to final clean up via SEC, other chromatographic techniques were employed to further purify the target scFv protein from residual host cell contaminants and aggregates. These conventional techniques included anion exchange, cation exchange, and hydrophobic interaction. Other affinity based approaches were also used, including, but not limited to: utilization of the c-terminal myc tag via anti-myc resin or ligand based affinity approaches using the appropriate ligand covalently coupled to a rigid bead. The utility of these other techniques were determined on a protein to protein basis.

Size Exclusion Chromatography (SEC)

Amount of protein as assessed by UV @ A280 nm and analytical SEC method determined the size of gel filtration column used: <1 mg=10/300 Superdex 200 GL column, 1-10 mg =16/60 Superdex 200, >10 mg=26/60 Superdex 200 (All GE Healthcare). IMAC elution pool was concentrated using 10 kD MWCO Ultracel centrifugal concentrator (Millipore) with the final concentrate volume being no more than 3% of the volume of gel filtration column used. Concentrate was injected onto column and the protein eluted isocratically at a flow rate not to exceed 76 cm/hr and no slower than 34 cm/hr. Elution fractions were analyzed by SDS-PAGE, and the appropriate pool made.

Endotoxin Removal

Final product specifications regarding endotoxin levels were determined by status of a particular cluster. SEC pool was concentrated to >0.25 mg/mL as determined by UV @ A280 nm using a 10 kD MWCO Ultracel centrifugal concentrator (Millipore). A Mustang E 0.22 um filter (PALL) was pre-wetted with SEC mobile phase buffer and the SEC concentrate filtered through it via manual syringe delivery system at a flow rate of ~1 mL/min. Final filtered product was assayed for endotoxin using PTS EndoSafe system (Charles River), concentration via UV @ A280 nm, and aliquoted for storage.

EXAMPLE 8

Establishing 293/KDR/KZ136 Reporter Cell Line

To test for the ability of molecules to neutralize VEG-$A_{165}$ activity, a luciferase reporter cell line was created. 293/KDR cells, (Sibtech, Inc. Newington, Conn.), which stably-express VEGF-R2 (KDR/Flk-1), were seeded at a density of 250,000 cells/well in 6-well plates in complete medium (DMEM, 10% fetal bovine serum (FBS), 1× Sodium Pyruvate, 1× GlutaMax (Invitrogen)) and allowed to attach overnight at 37° C. in a humidified incubator at 5% $CO_2$. The following day, cells were transfected using Lipofectamine 2000 (Invitrogen) and pKZ136 (ZymoGenetics, Inc), a plasmid containing a STAT-SRE-Luciferase cassette and neomycin selection marker using manufacturer's protocol. Signaling through VEGF-R2 will induce activation of the serum-response element (SRE) and mediate expression of luciferase. Briefly, 4 μg pKZ136 was added to 250 μl serum-free DMEM in one tube and 10 μl Lipofectamine 2000 reagent was added to 250 μl serum-free DMEM in another tube. Both tubes were mixed gently, incubated 5 min at room temperature (RT), and combined for 500 μl total volume. After 20 minutes at RT, complete medium was aspirated from the cells and the 500 μl Lipofectamine/DNA mix was added to the well. After 5 hours at 37° C., 5% $CO_2$, 2 mL complete medium was added and cells were returned to the incubator and incubated overnight. The following day, medium was replaced with complete medium containing 500 μg/mL Geneticin (G418 Sulfate, Invitrogen) and selection for stable transfectants occurred in 10-14 days.

Following establishment of the 293/KDR/KZ136 Geneticin-resistant cells, individual clones were isolated by limiting dilution method. Briefly, several 96-well culture plates were plated at a seeding density of 0.25 cells/well in 200 μl complete medium. After 15-20 days, wells that showed a single colony established were isolated and screened for luciferase activity in response to VEGFA-165. Isolated clones were plated in triplicate at a seeding density of 10,000 cells/well in 96-well opaque white cell-culture coated plates (Costar 1/3917) in complete medium and allowed to attach overnight. The following day, complete medium was removed by vacuum aspiration and replaced with 100 μl serum-free medium (DMEM, 1× Sodium Pyruvate, 1× GlutaMax, (Invitrogen)) and cells were serum-starved overnight. The next day, VEGF-$A_{165}$ was added at concentrations of 0.0263, 0.263, and 2.63 nM in serum-free medium and incubated at 37° C. for 4 hours. Luciferase activity was measured using the Luciferase Assay System (Promega, E1501) and a microplate luminometer (Berthold Technologies) according to manufacturer's protocol. Clone with the highest luciferase activity was designated 293/KDR/KZ136/c22 and used for screening assays.

EXAMPLE 9

Identification of Neutralizing Anti-VEGF scFvs Using the 293/KDR/KZ136/c22 VEGFA-Induced VEGF-R2 Phosphorylation Luminex Assay To screen candidate molecules (scFv's, Fabs) for their ability to neutralize the activity of VEGFA, a cell-based luminex assay that measures phosphorylation of VEGF-R2 (KDR/Flk-1) was performed. 293/KDR/KZ136/c22 cells were plated at a density of 20,000 cells per well in 100 μl complete medium (DMEM, 10% fetal bovine serum (FBS), 1× Sodium Pyruvate, 1× GlutaMax (Invitrogen)) in clear 96-well tissue culture plates and allowed to attach overnight. The following day, complete medium was removed by vacuum aspiration and replaced with 100 μl serum-free medium (DMEM, 1× Sodium Pyruvate, 1× GlutaMax). Cells were incubated overnight.

The following day, candidate VEGF-A neutralizing molecules (scFv's, Fabs), positive controls (bevacizumab (anti-VEGFA monoclonal antibody, Genentech), ranibizumab (anti-VEGFA affinity-matured Fab, Genentech), and bevacizumab Fab (generated in-house) were serially diluted from 200 nM down to 12 pM at 1:5 dilutions along with a non-neutralizer (medium only) in serum-free medium. To these, an equal volume of VEGF-$A_{165}$ was added at 0.54 nM for a final concentration of 0.26 nM VEGF-A and 100 nM to 6 pM neutralizing molecule or positive control. These were incubated for 60 minutes at 37° C.

Following incubation, medium was removed from serum-starved cells by vacuum aspiration and replaced with 100 μl of above complexes. Cells were incubated for 10 minutes at 37° C. Following incubation, medium was removed by vacuum aspiration and cells were gently washed with 100 μl ice-cold phosphate-buffered saline (PBS, Invitrogen). PBS was removed by vacuum aspiration and cells were lysed in 25 μl NP-40 lysis buffer (Invitrogen Cat.# FNN0021) containing 1 mM PMSF (Sigma, P-2714 in DMSO) and 1 Complete Mini tablet per 10 mL (Roche, 11836153001). Lysates were incubated for 20 minutes at 4° C. on a platform shaker and centrifuged at 3000 rpm for 10 min at 4° C. to clear lysates. Lysates were transferred to a fresh 96-well microtiter plate and placed at −20° C. until assay.

For the VEGF-R2 phosphorylation luminex assay, the Intracellular Protein Buffer Reagent Kit (Invitrogen LHB0002) and VEGFR2 [pY1059] Antibody Bead Kit (Invitrogen LHO0601) was used according to manufacturer's instructions. Lysates were thawed and mixed 1:5 with 80 μl Assay Diluent. Wells of a luminex vacuum filtration plated were pre-wetted with 200 μl Working Wash Solution. Diluted beads were added at 25 μl per well and washed 2× with 200 μl Working Wash Solution. Following washing, 50 μl of diluted lysate, and 50 μl of diluted detector antibody was added to each well and plates were covered in foil and incubated for 3 hours at room temperature (RT) on a platform shaker at 500 rpm. Following incubation, beads were washed 2× with 200 μl Working Wash Solution and then 100 μl of diluted Anti-Rabbit IgG-RPE was added to each well and plates were covered in foil and incubated for 30 minutes at RT on a platform shaker at 500 rpm. Following incubation, beads were washed 3× with 200 μl Working Wash Solution, and resuspended in 125 μl Working Wash Solution. Beads were resuspended for 30 seconds on a platform shaker at 500 rpm and read in Luminex-100 instrument (BioRad). Data was analyzed using analytical software (Spotfire) and $IC_{50}$ values were calculated for each candidate and control.

The act of $VEGF-A_{165}$ binding to its receptor, VEGF-R2 (KDR/Flk-1), induces phosphorylation of the receptor. This luminex-based assay binds total VEGF-R2 to a fluorescently-labeled bead conjugated to an anti-VEGF-R2 antibody. A secondary antibody detecting phosphorylation at [pY1059] is used to detect how much VEGF-R2 has been phosphorylated. A decrease in receptor phosphorylation indicates that this VEGF-A-mediated activation is being neutralized.

EXAMPLE 10

Testing Cross-reactivity of VEGF-binding scFvs Against Murine VEGF-A

To screen candidate molecules (scFvs, Fabs) for their ability to neutralize the activity of murine VEGFA, a cell-based luminex assay that measures VEGF-R2 (KDR/Flk-1) phosphorylation was performed. Since mVEGF-164 will cross-react to human VEGF-R2, a human VEGF-R2-based reporter system can be utilized. 293/KDR/KZ136/c22 cells were plated at a density of 20,000 cells per well in 100 μl complete medium (DMEM, 10% fetal bovine serum (FBS), 1× Sodium Pyruvate, 1× GlutaMax (Invitrogen)) in clear 96-well tissue culture plates and allowed to attach overnight. The following day, complete medium was removed by vacuum aspiration and replaced with 100 μl serum-free medium (DMEM, 1× Sodium Pyruvate, 1× GlutaMax). Cells were incubated overnight.

The following day, candidate VEGF-A neutralizing molecules (scFvs, Fabs) were serially diluted from 200 nM down to 12 pM at 1:5 dilutions along with a non-neutralizer (medium only) in serum-free medium. VEGF-R2-Fc was used as a positive control for neutralization. To these, and equal volume of $mVEGF-A_{164}$ (493-MV-005, R&D Systems) was added at 0.54 nM for a final concentration of 0.26 nM VEGA and 100 nM to 6 pM neutralizing molecule or positive control. These were incubated for 60 minutes at 37° C.

Following incubation, medium was removed from serum-starved cells by vacuum aspiration and replaced with 100 μl of above complexes. Cells were incubated for 10 minutes at 37° C. Following incubation, medium was removed by vacuum aspiration and cells were gently washed with 100 μl ice-cold phosphate-buffered saline (PBS, Invitrogen). PBS was removed by vacuum aspiration and cells were lysed in 25 μl NP-40 lysis buffer (Invitrogen Cat.# FNN0021) containing 1 mM PMSF (Sigma, P-2714 in DMSO) and 1 Complete Mini tablet per 10 mL (Roche, 11836153001). Lysates were incubated for 20 minutes at 4° C. on a platform shaker and centrifuged at 3000 rpm for 10 min at 4° C. to clear lysates. Lysates were transferred to a fresh 96-well microtiter plate and placed at −20° C. until assay.

For the VEGF-R2 phosphorylation luminex assay, the Intracellular Protein Buffer Reagent Kit (Invitrogen LHB0002) and VEGFR2 [pY1059] Antibody Bead Kit (Invitrogen L1-100601) was used according to manufacturer's instructions. Lysates were thawed and mixed 1:5 with 80 μl Assay Diluent. Wells of a luminex vacuum filtration plated were pre-wetted with 200 μl Working Wash Solution. Diluted beads were added at 25 μl per well and washed 2× with h200 μl Working Wash Solution. Following washing, 50 μl of diluted lysate, and 50 μl of diluted detector antibody was added to each well and plates were covered in foil and incubated for 3 hours at room temperature (RT) on a platform shaker at 500 rpm. Following incubation, beads were washed 2× with 200 μl Working Wash Solution and then 100 μl of diluted Anti-Rabbit IgG-RPE was added to each well and plates were covered in foil and incubated for 30 minutes at RT on a platform shaker at 500 rpm. Following incubation, beads were washed 3× with 200 μl Working Wash Solution, and resuspended in 125 μl Working Wash Solution. Beads were resuspended for 30 seconds on a platform shaker at 500 rpm and read in Luminex-100 instrument (BioRad). Data was analyzed using analytical software (Spotfire) and $IC_{50}$ values were calculated for each candidate and control.

The act of $mVEGF-A_{164}$ binding to human receptor, VEGF-R2 (KDR/Flk-1), induces phosphorylation of the receptor. This luminex-based assay binds total VEGF-R2 to a fluorescently-labeled bead conjugated to an anti-VEGF-R2 antibody. A secondary antibody detecting phosphorylation at [pY1059] is used to detect how much VEGF-R2 has been phosphorylated. A decrease in receptor phosphorylation indicates that this $mVEGF-A_{164}$-mediated activation is being neutralized.

EXAMPLE 11

Identification of Neutralizing Anti-VEGF scFvs Using the 293/KDR/KZ136/c22 VEGF-A-induced Cell-Based Luciferase Assay To screen candidate molecules (scFv's, Fabs) for their ability to neutralize the activity of VEGFA, a cell-based luciferase assay was performed. 293/KDR/KZ136/c22 cells were plated at a seeding density of 10,000 cells per well in 96-well opaque white tissue-culture treated plates (Costar #3917) in 100 μl complete medium (DMEM, 10% fetal bovine serum (FBS), 1× Sodium Pyruvate, 1× GlutaMax (Invitrogen)) and incubated 48 hours in a 37° C. humidified 5% $CO_2$ incubator. After 48 hours, complete medium was removed by vacuum aspiration and replaced with 100 μl serum-free medium (DMEM, 1× Sodium Pyruvate, 1× GlutaMax (Invitrogen)) and incubated overnight.

The following day, candidate VEGA neutralizing molecules (scFv's, Fabs), positive controls (bevacizumab (anti-VEGFA monoclonal antibody, Genentech), ranibizumab (anti-VEGFA affinity-matured Fab, Genentech), and bevacizumab Fab generated in-house) were serially diluted from 200 nM down to 12 pM at 1:5 dilutions along with a non-neutralizer (medium only) in serum-free medium. To these, and equal volume of VEGFA-165 was added at 0.54 nM for a final concentration of 0.26 nM VEGA and 100 nM to 6 pM neutralizing molecule or positive control. These were incubated for 60 minutes at 37° C. Following incubation, medium was aspirated off the serum-starved cells and 100 µl of the above complexes were added and incubated at 37° C. for 4 hours.

Following 4 hour incubation, a luciferase assay was performed using the Luciferase Assay System (Promega, E1501) according to the manufacturer's instructions. Briefly, medium was aspirated and 25 µl 1× is Buffer (Promega, E153A) was added to each well. Plates were incubated for 20-30 minutes at RT to equilibrate. Luciferase activity was measured using a microplate luminometer (Berthold Technologies), 40 µl substrate injection, 1 second integration time. Data was analyzed using analytical software (Spotfire) and $IC_{50}$ values were calculated for each candidate and control.

The act of VEGF-$A_{165}$ binding to its receptor, VEGF-R2 (KDR/Flk-1), induces a signaling cascade that activates STAT (signal transducer and activator of transcription) and/or SRE (serum-response element) which drives transcription of the luciferase reporter gene. A decrease in luciferase activity indicates that this VEGFA-mediated signaling is being neutralized.

Results scFvs and BiAbs listed in Tables 11 and 12 below were screened in the luciferase assay for neutralizing VEGF-induced activity. Significant inhibition was demonstrated with a number of scFvs and BiAbs screened (reported as IC50 values in Tables 11 and 12). IC50 values are indicated as nM concentration of scFv needed to neutralize VEGF-activity by 50%. Bevacizumab (Avastin™), Lucentis™, and Avastin™ Fab (generated in-house) were used as controls for activity.

TABLE 11

Anti-VEGF-A scFv Neutralization Activity in Cell-based Luciferase Assay

| scFvs and controls | Luciferase IC50 (nM) |
|---|---|
| Avastin ™ | 0.1-0.4 |
| Lucentis ™ | 0.1-0.5 |
| Avastin ™ Fab | 2.9-6.45 |
| c636.1_1 | 0.10 |
| c721.1_1 | 1.47 |
| c721.1_2 | 0.23 |
| c752.1_1 | 1.09 |
| c831.1_1 | 0.25 |
| c1036.1_1 | 0.31 |
| c1044.1_1 | 0.09 |
| c1090.1_1 | 0.43 |
| c1094.1_1 | 0.95 |
| c1155.1_1 | 0.2 |
| c1080.1_1 | 0.01 |
| c1135.1_1 | 0.4 |
| c1270.1_1 | 0.3 |
| c1285.1_1 | 0.13 |
| c1257.1_1 | 0.34 |
| c1410.1_1 | 0.08 |
| c1476.1_1 | 0.2 |
| c641.1_1 | 3.1 |
| c648.1_1 | 0.2 |
| c868.1_1 | 0.5 |
| c870.1_1 | 0.3 |
| c1039.1_1 | 0.07 |
| c1092.1_1 | 15.23 |

TABLE 12

Anti-VEGF-A BiAb Neutralization Activity in Cell-based Luciferase Assay

| BiAbs | Luciferase IC50 (nM) |
|---|---|
| A2096F (c1111) BiAb | 0.13 |
| A2100F (c868) BiAb | 0.212 |
| A2105F (c868) dimer | 0.22 |
| A2097F (c870) BiAb | 0.335 |
| A2099F (c1039) BiAb | 0.04 |
| A2101F (c1081) BiAb | 10.08 |
| A2098F (c1092) BiAb | 2.33 |
| 162.6262/bevacizumab Biab | 0.08 |

EXAMPLE 12

Proliferation Assay to Determine Neutralizing Activity of VEGFA scFvs on VEGF-A-stimulated HUVEC Cells To screen for a neutralizing VEGF-A scFv that had a moderate affinity for VEGF-A, a $^3$H-thymidine assay was run. Recombinant human VEGF-$A_{165}$ was used as a positive control at 2.6 nM. DMEM-F12 (1:1) media with 1× insulin-transferrin-selenium (serum-free media, SFM; Invitrogen, Carlsbad, Calif.) was used as a negative control. Human VEGF-A scFv was serially diluted in SFM at 500 nM, 50 nM, 5 nM, 0.5 nM, 0.05 nM, 0.005 nM, and 0.0005 nM. Human umbilical vein endothelial cells (HUVEC) were plated into 96-well flat-bottom plates in a volume of 100 µL at a density of 900-1000 cells per well. The HUVEC cells were plated for 2 days in complete EGM-2 MV media (Lonza, Walkersville, Md.) at 37° C., 5% $CO_2$. The cells were serum-starved with SFM for 24 h, stimulated for 24 h with 2.6 nM with or without the serially diluted VEGF-A scFv, and pulsed for 24 h with 1 µCi per well of $^3$H-thymidine, which is incorporated into proliferating cells (all at 37° C., 5% $CO_2$). The cells were harvested and counted using Topcount instrument (Hewlett Packard).

Results: A large number of scFvs and BiAbs screened in the assay showed potent neutralization of VEGF-induced HUVEC proliferation as seen by low nM IC50 values as shown in Tables 13 and 14 below.

TABLE 13

Anti-VEGF-A scFv Neutralizing Activity in HUVEC Proliferation Assay

| scFvs and controls | Proliferation IC50 (nM) |
|---|---|
| Avastin ™ | 0.3-0.6 |
| Lucentis ™ | 0.3-0.8 |
| Avastin ™ Fab | 14-17 |
| c636.1_1 | 0.99 |
| c721.1_1 | 7.45 |
| c721.1_2 | 1.67 |
| c752.1_1 | 2.90 |
| c831.1_1 | 0.25 |
| c1036.1_1 | 0.72 |
| c1044.1_1 | 0.43 |
| c1090.1_1 | 0.61 |
| c1094.1_1 | 1.0 |
| c1155.1_1 | 0.13 |
| c1080.1_1 | 0.58 |
| c1135.1_1 | 0.99 |
| c1270.1_1 | 0.9 |
| c1285.1_1 | 0.86 |

TABLE 13-continued

Anti-VEGF-A scFv Neutralizing Activity
in HUVEC Proliferation Assay

| scFvs and controls | Proliferation IC50 (nM) |
|---|---|
| c1257.1_1 | 2.2 |
| c1410.1_1 | 0.65 |
| c1476.1_1 | 0.17 |
| c641.1_1 | 6.3 |
| c648.1_1 | 0.01 |
| c868.1_1 | 3.1 |
| c870.1_1 | 0.8 |
| c1039.1_1 | 0.77 |
| c1092.1_1 | 16.6 |

TABLE 14

Anti-VEGF-A BiAb and Dimer Neutralizing Activity in
HUVEC Proliferation Assay

| BiAbs and dimers | Proliferation IC50 (nM) |
|---|---|
| A2096F (c1111) BiAb | 2.27 |
| A2100F (c868) BiAb | 0.57 |
| A2105F (c868) dimer | 0.84 |
| A2097F (c870) BiAb | 0.8 |
| A2099F (c1039) BiAb | 0.19 |
| A2101F (c1081) BiAb | 4.15 |
| A2098F (c1092) BiAb | 1.08 |
| 162.6262/bevacizumab Biab | 2.27 |

EXAMPLE 13

PDGFRβ-Fc5 pZMP45 Plasmid Construction and Expression in 293F Cells

An expression plasmid encoding PDGFRβ-Fc5 was constructed in vector pZMP45 via homologous recombination in yeast. The PDGFRβ-Fc5 fragment was created with PCR, using a pre-existing expression plasmid containing the PDGFRβ (amino acids 1-530) Fc5 sequence as template. The forward primer zc58363 (CTCTCCACAGGTGTC-CTCGAGAATTCATATAGGCCG GCCACCATGCGGCT-TCCGGGTGCGATGCCAG; SEQ ID NO:483) created a 5' overlap in pZMP45, and the reverse primer zc52514 (GGGGTGGGTACAACCCCAGAGCTGTTTTAAGGCG CGCCTCTAGATTATTTACCCGGAGACAGGGAGAG-GCTCTT; SEQ ID NO:484) created a 3' overlap in pZMP45.

The PCR conditions, using Platinum® PCR SuperMix High Fidelity (Invitrogen, Cat. #12532-016), were as follows: 1 cycle 94° C. for 2 min; 30 cycles 94° C. for 30 sec., 55° C. for 30 sec, 68° C. for 2:30 min; then hold at 4° C. The PCR reaction mixture was then run on a 1% agarose gel with 1×TAE. The correct band was excised and purified using Qiagen's gel purification kit (Qiagen, catalog #28704).

Plasmid pZMP45 is a mammalian expression vector containing an expression cassette having the CMV immediate early promoter/enhancer, CMV Intron A, multiple restriction sites for insertion of coding sequences, and an optimized tPA signal peptide sequence, the SV40 terminator, an E. coli origin of replication, and URA3 and CEN-ARS sequences required for selection and replication in S. cerevisiae.

One hundred µL of electrocompetent yeast cells (S. cerevisiae) were combined with 4 µl of purified DNA from above, mixed with 100 ng of BglII-cut pZMP45 plasmid, and transferred to a 0.2 cm electroporation cuvette. The yeast-DNA mixture was electropulsed at 0.75 kV (5 kV/cm), ∞ ohms, 25 µF. To each cuvette was added 1 ml of 1.2M sorbitol, and the yeast were plated onto a URA-DS plate and incubated at 30° C. After about 72 hours, approximately 50 µL packed yeast cells taken from the Ura+ yeast transformants of a single plate was resuspended in 100 µL of lysis buffer (2% Triton X-100, 1% SDS, 100 mM NaCl, 10 mM Tris, pH 8.0, 1 mM EDTA), 100 µL of Qiagen P1 buffer from a Qiagen miniprep kit (Qiagen, Valencia, Calif., catalog #27104), and 20 U of Zymolyase (Zymo Research, Orange, Calif., catalog #1001). This mixture was incubated for 30 minutes at 37° C., and the remainder of the Qiagen miniprep protocol was performed, starting with the addition of reagent P2. The DNA was eluted with 40 µL EB reagent.

Fifteen µL electrocompetent E. coli cells (DH112S, Invitrogen, Carlsbad, Calif.) were transformed with 2 µL yeast DNA in a 0.2 cm electroporation cuvette. The cells were electropulsed at 1.75 kV, 25 µF, and 400 ohms. Following electroporation, 1 ml SOC (2% Bacto Tryptone (Difco, Detroit, Mich.), 0.5% yeast extract (Difco), 10 mM NaCl, 2.5 mM KCl, 10 mM $MgCl_2$, 10 mM $MgSO_4$, mM glucose) was added to the cuvette. This solution was plated on two LB AMP plates (LB broth (Lennox), 1.8% Bacto Agar (Difco), 100 mg/L Ampicillin), one with 200 µL of transformants, the second with 100 µL.

Individual clones were picked from the transformation plates, and were sequenced to identify one clone containing the correct expression construct for PDGFRβ-Fc5. Larger scale plasmid DNA was isolated using the Invitrogen mega prep kit (Invitrogen, Carlsbad, Calif., catalog #457009) according to manufacturer's instructions.

Transfection into 293F Cells

To test for expression of PDGFRβ-Fc5, 1 million 293F cells were transiently transfected using 1 µg plasmid DNA and 1.3 µl Lipofectamine-2000 (Invitrogen, Carlsbad, Calif., catalog #11668-019) in 100 µl OptiMEM (Invitrogen, Carlsbad, Calif., catalog #31985-070), following the Lipofectamine-2000 product procedure. The cells were grown in one well of a 12-well plate, shaking at 120 rpm, 37° C., 6% $CO_2$. After 96 hours, medium was harvested and prepared for a Western blot assay.

Invitrogen materials and protocols were used for the Western blot with HRP-Goat anti-human IgG (H+L) (Jackson ImmunoResearch catalog #109-035-003) as the detection antibody. Significant expression was observed, so a large scale transfection was initiated.

EXAMPLE 14

Panning for Antibodies that Bind PDGFRβ

Antibodies that bind to the extracellular domain of PDGFRβ were identified by screening Dyax Fab 310 and 410 phage libraries (Dyax Corp., Cambridge, Mass.). Selection and screening of the phage-antibody libraries utilized immobilized biotinylated antigen (PDGFRβ-Fc5; SEQ ID NO:486) captured on magnetic beads, Dynabeads M-280 Streptavidin (#112-06D, Invitrogen Dynal AS, Oslo, Norway). The antibodies were isolated by increasing the stringency after a few rounds of selection. The first generation of antibodies was in the Fab format. The soluble Fab antibodies were generated by MluI (#R0198S, New England Biolabs, Beverly, Mass.) enzyme digestion to remove the gene 3 from M13 phage. The same strategy of selection, screening and solubilizing was applied for antibodies in the scFv format.

EXAMPLE 15

Plate-based Binding Assay for PDGFRβ

Positive clones from Fab format for PDGFRβ were screened by a plate based binding assay. Costar (#9018) 96-well plates were coated with 50 µl of anti-human IgG Fcg-specific antibody (#109-005-098, Jackson Immunology) at 1 µg/ml in 0.1M NaHCO$_3$, pH 9.6 overnight at 4° C. The next day, plates were washed three times with 0.1% Tween-20/PBS (PBST). Each well was filled with 100 µl of 5% milk (#170-6404, Bio-Rad)/PBST for one hour at room temperature (RT) for blocking. 50 µl of either PDGFRβ-Fc5 (SEQ ID NO:486) or IL-27RA-Fc5 (SEQ ID NO:487) at 0.25 µg/ml in 2% BSA (#160069 MB Biomedicals)/PBST was added to each well for one hour at RT. Plates were washed three times with PBST. Each well was filled with 100 µl of 5% milk/PBST for one hour at RT for blocking. Assay plates were then washed three times with PBST. Each well was filled with 50 µl of Fab. Wells were then mixed and then incubated for one hour at RT. Plates were washed three times with PBST. For Fab detection, 50 µl of (1:4000) anti-Human Fab specific pAb-HRP (#31482, Pierce) in 2% BSA/PBST was added to each well for one hour at RT. Plates were then washed three times with PBST. 50 µl of TMB (TMBW-1000-01, BioFX Laboratories) was added to each well to develop for 10-20 min, followed by the addition of 50 µl of stop buffer (STPR-1000-01, BioFX Laboratories) to quench the reaction. Plates were then read at 450 nm on a plate reader.

EXAMPLE 16

PDGFRβ Fab-ScFv Conversion

Lambda, kappa, and heavy chain variable regions were amplified from a pool of 10 round 2 PDGFRβ-panned Fab Dyax phage DNA arms in a 3 step process using primers directed against framework sequences for each subtype. The first round PCR amplifies each of the variable framework regions and adds appropriate overhangs to facilitate round 2 PCR reactions. Round 2 PCR reactions add appropriate gly/ser linker sequences to the ends of the proper round 1 PCR products and round 3 PCR reactions overlap the variable light chain lambda, variable light chain kappa and variable heavy chain products to create scFv products in both LH and HL orientations, which were then cloned into ApaLI/NotI-digested PIMD21 phage display vector.

EXAMPLE 17

Identification of Neutralizing sFab and scFv Using a Plate-based Neutralization Assay for PDGFRβ

PDGFRβ Fabs and scFvs were screened by a plate-based neutralization assay. Costar (#9018) 96-well plates were coated with 50 µl of anti-human IgG Fcg-specific antibody (#109-005-098, Jackson Immunology) at 1 µg/ml in 0.1M NaHCO$_3$, pH 9.6 overnight at 4° C. The next day, plates were washed three times with 0.1% Tween-20/PBS (PBST). Each well was filled with 100 µl of 5% milk (#170-6404, Bio-Rad)/PBST for one hour at room temperature (RT) for blocking. 50 µl of PDGFRβ (made in-house) at 0.25 µg/ml in 2% BSA (#160069 MB Biomedicals)/PBST was added to each well for one hour at RT. Plates were washed three times with PBST. Each well was filled with 100 µl of 5% milk/ PBST for one hour at RT for blocking. Assay plates were then washed three times with PBST. Each well was filled with 50 µl of a (1:1) mixture of either Fab or scFv supernatant and biotinylated PDGF-B (SEQ ID NO:488) homodimer (PDGF-BB) at 0.0112 µg/ml in 2% BSA/PBST for one hour at RT. Plates were washed three times with PBST. 50 µl of (1:3000) Streptavidin-HRP (#21124, Pierce) in 2% BSA/PBST was added to each well for one hour at RT. Plates were then washed three times with PBST. 50 µl of TMB (TMBW-1000-01, BioFX Laboratories) was added to each well to develop for 20-30 min, followed by the addition of 50 µl of stop buffer (STPR-1000-01, BioFX Laboratories) to quench the reaction. Plates were then read at 450 nm on a plate reader.

EXAMPLE 18

Measurement of Binding Affinities of Human PDGF-BB to Human PDGF Receptor-β Via Surface Plasmon Resonance (Biacore)

Kinetic rate constants and equilibrium dissociation constants were measured for the interaction of PDGFR-β-Fc5 with the PDGF-BB via surface plasmon resonance. Surface plasmon resonance allows monitoring of both association and dissociation phases during biomolecular interactions (Ohlson, *J. Mal. Recognit.*, 1997). The association rate constant ($k_a$ ($M^{-1}s^{-1}$)) is a value that reflects the rate of the antigen-antagonist complex formation. The dissociation rate constant ($k_d$ ($s^{-1}$)) is a value that reflects the stability of this complex. By dividing the association rate constant by the dissociation rate constant ($k_a/k_d$) the equilibrium association constant ($K_A$ ($M^{-1}$)) is obtained. By dividing the dissociation rate constant by the association rate constant ($k_d/k_a$) the equilibrium dissociation constant ($K_D$ (M)) is obtained. This value describes the binding affinity of the interaction. Interactions with the same $K_c$, can have widely variable association and dissociation rate constants. Consequently, measuring both the $k_a$ and $k_d$ helps to more accurately describe the affinity of the interaction.

Affinity Determination

Kinetic rate constants and equilibrium dissociation constants were measured for the interaction of the PDGF-BB with PDGFR-β-Fc5 via surface plasmon resonance. The association rate constant ($k_a$ ($M^{-1}s^{-1}$)) is a value that reflects the rate of the antigen-antagonist complex formation. The dissociation rate constant ($k_d$ ($s^{-1}$)) is a value that reflects the stability of this complex. By dividing the association rate constant by the dissociation rate constant ($k_a/k_d$) the equilibrium association constant ($K_A$ ($M^{-1}$)) is obtained. By dividing the dissociation rate constant by the association rate constant ($k_d/k_a$) the equilibrium dissociation constant ($K_D$ (M)) is obtained. This value describes the binding affinity of the interaction. Interactions with the same $K_D$ can have widely variable association and dissociation rate constants. Consequently, measuring both the $k_a$ and $k_d$ helps to more accurately describe the affinity of the interaction.

Materials and Methods

A series of experiments were completed to measure the binding affinity of PDGF-BB interaction with PDGFR-β. Binding kinetics and affinity studies were performed on a Biacore T100™ system (GE Healthcare, Piscataway, N.J.). Methods were programmed using Biacore T100™ Control Software, v 1.1.1. To capture a PDGFR-β-Fc5 fusion molecule, goat anti-human IgG Fc-gamma (Jackson ImmunoResearch, West Grove, Pa.) was covalently immobilized on a CM5 sensor chip using amine coupling chemistry (EDC: NHS) to a density of approximately 10,000 RU. PDGFR- β-Fc5 was then injected onto this surface at a flow rate of 10 ul/min for 90 seconds to capture approximately 500RUs.

Serial 1:3 dilutions of human PDGF-BB ranging from 1.37 nM to 0.02 nM were injected over the surface and allowed to specifically bind to the PDGFR-β-Fc5 immobilized on a sensor chip. Injections of PDGF-BB concentrations were performed with an association time of 5 minutes and dissociation time of 5 minute. Kinetic binding studies were performed with a flow rate of 50 µL/min. All binding experiments were performed at 25° C. in a buffer of 10 mM HEPES, 500 mM NaCl, 3 mM EDTA 0.05% Surfactant P20, 1 mg/ml bovine serum albumin, pH 7.4. Buffer injections were also performed to allow for subtraction of instrument noise and drift. Between cycles, the flow cell was washed with 10 mM Glycine, pH 1.75 to regenerate the surface.

Data was compiled using Biacore T100™ Evaluation software (version 1.1.1). Data was processed by subtracting reference flow cell and blank injections. Baseline stability was assessed to ensure that the regeneration step provided a consistent binding surface throughout the sequence of injections. Duplicate injection curves were checked for reproducibility. The 1:1 binding model was determined to be the most appropriate and the resulting binding curves were globally fitted to this model.

Results

PDGF-BB was characterized for its binding affinity for PDGFR-β-Fc5 (results summarized in Table 15). Association rate constants ($k_a$ ($M^{-1}s^{-1}$)) and dissociation rate constants ($k_d$ ($s^{-1}$)) were measured. $K_D$ and $K_A$ were calculated from the $k_a$ and $k_d$ values. The data fit well to the 1:1 interaction model. Under these assay conditions, equilibrium dissociation constant for PDGF-BB-PDGFR-β-Fc5 interaction was approximately $2.E^{-11}$ M.

TABLE 15

Characterization of PDGF-BB Binding Affinity for PDGFRβ

| Interaction | $k_a$ ($M^{-1}s^{-1}$) | $k_d$ ($s^{-1}$) | $K_D$ (M) | $K_A$ ($M^{-1}$) |
| --- | --- | --- | --- | --- |
| PDGF-BB/ PDGFRβ-Fc5 | 6.E+7 | 1.E−3 | 2.E−11 | 6.E+10 |

EXAMPLE 19

Measurement of Dissociation Rate Constants for the Interaction of Human PDGF Receptor-β Antagonists with Human PDGF Receptor-β Via Surface Plasmon Resonance (Biacore)

Human PDGFR-β antagonists were evaluated for their binding affinity to human PDGFR-β as reflected in their dissociation rate constants using surface plasmon resonance. Dissociation rate constants were measured for the interaction of PDGFR-β antagonists with the PDGFR-β via surface plasmon resonance. The dissociation rate constant ($k_d$ ($s^{-1}$)) is a value that reflects the stability of this complex. It is independent of the concentration and therefore suitable for screening and ranking samples with unknown concentrations.

Materials and Methods

A series of experiments were completed to measure the binding affinity of the PDGFR-β antagonists to PDGFR-β. Binding kinetics and affinity studies were performed on a Biacore T-100™ system (GE Healthcare, Piscataway, N.J.). Methods were programmed using Biacore T100™ Control Software, v 1.1.1. To capture a PDGFR-β-Fc5 molecule, goat anti-human IgG Fc-gamma (Jackson ImmunoResearch, West Grove, Pa.) was covalently immobilized on a CM5 sensor chip using amine coupling chemistry (EDC:NHS) to a density of approximately 10,000 RU. After the immobilization procedure, remaining active sites on the flow cell were blocked with ethanolamine. The non-specifically bound protein was removed by washing with 50 mM NaOH. PDGFRβ was diluted to 100 nM and then injected onto this surface at a flow rate of 10 ul/min for 2 minutes to capture about 500 RUs.

Human PDGFR-β antagonist supernatants (selected from a Dyax phage library screening) were diluted 1:3 in running buffer and injected over the surface and allowed to specifically bind to the PDGFR-β Fc5 captured on the sensor chip with an association time of 5 minutes and dissociation time of 5 minutes. Duplicate injections of PDGF-BB and an anti-PDGFR-β monoclonal antibody (ZymoGenetics) were performed as positive controls. A control flow cell was also prepared by immobilizing goat anti-human IgG Fc-gamma to a density of approximately 10,000 RU. In place of PDGFR-β Fc5, buffer was injected over this surface followed by injections of PDGFR-β antagonists. Kinetic binding studies were performed with a flow rate of 30 ul/min. All binding experiments were performed at 25° C. in a running buffer of 10 mM HEPES, 500 mM NaCl, 3 mM EDTA 0.05% Surfactant P20, 1 mg/ml bovine serum albumin, pH 7.4. Buffer injections were also performed to allow for subtraction of instrument noise and drift. Between cycles, the flow cell was washed with 10 mM Glycine, pH 1.75 to remove bound PDGFR-β Fc5.

Data was compiled using Biacore T100™ Evaluation software (version 1.1.1). Data was processed by subtracting reference flow cell and blank injections. Baseline stability was assessed to ensure that the regeneration step provided a consistent binding surface throughout the sequence of injections. Since the starting concentrations of the PDGFR-β antagonists were unknown, resulting binding curves were globally fit to a 1:1 dissociation binding model to calculate the dissociation rate constants ($k_d$ ($s^{-1}$)). This model does not depend on the concentration of the antagonist.

Results

Dissociation rate analysis of PDGFR-β antagonists to PDGFR-β Fc5 was determined. Resulting binding curves fit well to 1:1 dissociation binding model. The starting concentrations of the PDGFR-β antagonists were unknown, therefore only dissociation rate constants ($k_d$ ($s^{-1}$)) were reported since $k_d$ is independent of concentration. Calculated dissociation rate constants were ranked from slowest to fastest. Under these assay conditions, the PDGFR-β antagonists display a large range of dissociation rate constants ($1.E^{-6}$–$2.E^{-2}$ ($s^{-1}$)) for their interaction to PDGFR-β Fc5 (see Table 16). For comparison, the $k_d$ of PDGF-BB-PDGFR-β interaction was approximately $1.E^{-3}$ $s^{-1}$ and anti-PDGFR-β monoclonal antibody-PDGFR-β interaction was approximately $2.E^{-4}$ $s^{-1}$.

TABLE 16

Dissociation Rate Constants for Interaction of PDGFR-β Antagonists with PDGFR-β Fc5

| scFvs and controls | Off-rate [$k_d$ ($s^{-1}$)] |
| --- | --- |
| 162.6262 IgG | 2.E−04 |
| 162.6262 Fab | 9.E−04 |
| c597.1_2 | 4.E−04 |
| c613.1_1 | 3.E−04 |

TABLE 16-continued

Dissociation Rate Constants for Interaction of
PDGFR-β Antagonists with PDGFR-β Fc5

| scFvs and controls | Off-rate [$k_d$ (s$^{-1}$)] |
| --- | --- |
| c624.1_1 | 4.E-04 |
| c973 | 5.E-04 |
| c972 | 3.E-06 |
| c1035 | 4.E-05 |
| c1014 | 4.E-05 |
| c949 | 2.E-04 |
| c1226 | 3.E-05 |
| c947 | 5.E-04 |
| c951 | 7.E-04 |
| c971 | 3.E-04 |
| c1244 | 2.E-06 |
| c993 | 1.E-04 |
| c975 | 6.E-04 |
| c946 | 5.E-04 |
| c941 | 1.E-04 |
| c1245 | 3.E-06 |
| c939 | 6.E-04 |
| c1318 | 1.E-06 |

EXAMPLE 20

Cloning and Expression of BHK 570 Cells with a Serum Response Element Luciferase Reporter BHK 570 cells (ATCC, Manassas, Va.) were transfected in 100×20 mm tissue culture plates (Falcon, Colo. Springs, Colo.) with 10 ug of KZ67 plasmid DNA containing a serum response element, a luciferase reporter, and G418 resistance (ZymoGenetics, Inc) using lipofectamine (Invitrogen, Carlsbad, Calif.) according to the manufacturer's instructions. After 48 hours cells were removed with trypsin (Gibco Laboratories, Grand Island, N.Y.)) and seeded into 100×20 mm plates in growth media (DMEM (Gibco), 10% fetal bovine serum (FBS), 2 mM L-Glutamine and 1 mM sodium pyruvate plus 500 ug/ml Geneticin (Gibco) to select for stable transfectants, and were maintained in this media. After approximately one week stable cells were removed with trypsin, counted on a hemacytometer, and added to 96 well flat bottom plates (Falcon) at a density of one cell per well in a volume of 100 ul growth media plus Geneticin. After one week of growth, wells were scored for single colonies under a microscope. After additional growth cells were removed with trypsin and transferred to a new 96 well plate and allowed to become confluent. Cells were removed with 25 ul trypsin and resuspended in 75 ul growth media. Three replica plates were made, each with 30 ul of the cell mixture. Two plates were 96 well solid white (Corning Costar, Corning, N.Y.) for a luciferase assay and one was a clear 96 well plate (Falcon) for recovery of positive clones. The following day media on the white plates was replaced with serum free media. After serum starving the cells for two days one plate was induced with fresh media containing 20% FBS in a volume of 100 ul and media without serum was added to the other plate to determine the basal response. After incubating at 37° and 5% CO$_2$ for four hours a luciferase assay was performed with Promega (Madison, Wis.) E1500 Luciferase reagents according to the manufacturer's instructions. Plates were read on a Berthold LB96V-2R luminometer (Oak Ridge, Tenn.). Fold induction was calculated by dividing the signal from the wells with serum by those without serum. Positive clones were scaled up from the clear plate and retested by luciferase assay. Cells were seeded in 96 well white plates at 10,000 cells per well in 1% FBS and a luciferase assay was performed two days later with a dose response of FBS.

EXAMPLE 21

Cloning and Expression of BHK 570 KZ67 E10.2 B3 Cells with Human and Cynomologus Monkey PDGFRβ

BHK 570 E10.2 B3 cells (see above) were transfected as described above with human PDGFRβ in pzp9 plasmid containing a DHFR resistance gene (ZymoGenetics, Inc) or cynomologus monkey PDGFRβ in pzMP43 plasmid containing a zeocin resistant gene (ZymoGenetics, Inc). Cloning and luciferase assays were performed as above except that 250 nM methotrexate (Calbiochem, San Diego, Calif.) was used to select the human transfectants and 200 ug/ml zeocin (Invitrogen) was used for the cynomologus monkey transfectants. PDGF BB (ZymoGenetics, Inc) at a concentration of 10 ng/ml in assay media (DMEM, 0.5% bovine serum albumin (Gibco), 2 mM L-Glutamine, 1 mM sodium pyruvate, and 25 mM HEPES) was used for initial induction of clones from 96 well plates. Subsequent analysis on scaled up clones was performed with a dose response of PDGF BB from 100 to 0.01 ng/ml in assay media.

EXAMPLE 22

Identification of Neutralizing sFab and scFv Against PDGFRβ Using a Luminex-based Assay to Determine PDGFRβ Phosphorylation on Pericytes To screen for a neutralizing human PDGFRβ scFv a Luminex based assay was performed. The assay detects the amount of phosphorylated PDGFRβ that is present in cell lysates. Human Brain Vascular Pericytes (ScienCell Research, San Diego, Calif.) were seeded in 96 well flat bottom plates (Falcon, Colorado Springs, Colo.) at a density of 7,500 cells per well in a volume of 100 ul in complete media (ScienCell Pericyte Media (PM) plus ScienCell supplements Fetal Bovine Serum, Pericyte Growth Supplement, and Penicillin-Streptomycin) at 37° and 5% CO$_2$. On day two media was changed to ScienCell PM without supplements and serum starved for 24 hours. On day three media was removed from cells and serially diluted scFvs and control monoclonal antibody to PDGFRβ (ZymoGenetics, Inc, mouse anti-human, E9899) were added in assay media (ScienCell PM and 0.5% bovine serum albumin) in a volume of 50 ul and incubated for 60 minutes at 37° and 5% CO$_2$. PDGF BB (ZymoGenetics, Inc.) was added in 50 ul at 2× concentration to give a final concentration of 0.44 nM (EC$_{80}$ effective concentration at 80 percent) and incubated for 10 minutes at 37° and 5% CO$_2$ The cells were then washed with Bio-Plex Cell Wash Buffer, lysed with lysing solution according to the manufacturer's directions (BioRad, Hercules, Calif.), and the cell supernatants were frozen at −20° C. To thawed cell supernatants, 1× phospho-PDGFRβ beads were added and incubated at room temperature on a shaker for 18 h. Detection antibodies were added to the washed beads and incubated at room temperature on a shaker for 30 minutes, and then streptavidin-PE was incubated with the beads at room temperature for 15 minutes. The beads were resuspended in Bio-Plex Resuspension Buffer and analyzed on a Bio-Plex array reader (Bio-Rad Laboratories).

Results: scFvs, Fabs and BiAbs showed potent PDGFR phosphorylation neutralization induced by PDGF-BB as shown by low nM IC50 values in Tables 17 and 18 below.

TABLE 17

Anti-PDGFRβ scFv and Fab Neutralization Activity in Luminex-based Assay Using Pericytes

| scFvs, Fabs and controls | Phosphorylation IC50 (nM) |
|---|---|
| 162.6262 IgG | 0.05-0.2 |
| 162.6262 Fab | 8.0-28.0 |
| c597.1_2 | 3.66 |
| c613.1_1 | 8.3 |
| c624.1_1 | 6.8 |
| c973 | 13.26 |
| c972 | 0.60 |
| c1035 | 0.45 |
| c1014 | 0.01 |
| c949 | 1.1 |
| c1226 | 0.02 |
| c947 | 3 |
| c951 | 5.2 |
| c971 | 16.37 |
| c1244 | 0.62 |
| c993 | 0.1 |
| c975 | 5.02 |
| c946 | 14.66 |
| c941 | 0.11 |
| c1245 | 3.06 |
| c939 | 31.87 |
| c1318 | 5.76 |

TABLE 18

Anti-PDGFRβ BiAb Neutralization Activity in Luminex-based Assay Using Pericytes

| IgGs and BiAbs | Phosphorylation IC50 (nM) |
|---|---|
| c597.1_1 | 0.13 |
| c613.1_2 | 0.45 |
| c600.1_1 | 0.15 |
| A2100F (c868) | 0.04 |
| A2097F (c870) | 0.38 |
| A2099F (c1039) | 0.27 |
| A2101F (c1081) | 0.1 |
| A2098F (c1092) | 0.17 |
| A2096F (c1111) | 0.29 |
| c597.1_1 (A2104) | 0.22 |
| 162.6262/bevacizumab Biab | 0.03 |

EXAMPLE 23

Identification of Neutralizing sFab and scFv Against PDGFRβ Using a PDGF-BB-induced Percitye Proliferation Assay To screen candidate molecules (scFvs, Fabs) for their ability to neutralize proliferation induced by PDGF-BB activation of the human PDGFRβ, a $^3$H-thymidine assay was run. The assay measures the amount of radio-labeled nucleotide incorporated into the DNA of proliferating cells. Human Brain Vascular Pericytes (HBVP; ScienCell Research, San Diego, Calif.) were seeded in 96 well flat-bottom plates (Falcon, Colorado Springs, Colo.) at a density of 500 cells/well in 150 µl complete media (ScienCell Pericyte Media (PM) plus ScienCell supplements Fetal Bovine Serum, Pericyte Growth Supplement, and Penicillin-Streptomycin) at 37° C. in 5% $CO_2$. After 24-48 hours, complete media was replaced with DMEM-F12 (1:1) media with 1× insulin-transferrin-selenium (serum-free media, SFM; Invitrogen, Carlsbad, Calif.) and cells were incubated as before for an additional 18-24 hours. PDGFRβ-neutralizing molecules (scFvs, Fabs), a control monoclonal antibody against PDGFRβ (ZymoGenetics, Inc. E9899), or the Fab fragment of the E9899 monoclonal antibody (ZymoGenetics, Inc.) were serially diluted 1:4 from 2000 nM to 0.02 nM in SFM in the presence of a constant level of human PDGF-BB (0.4 nM, $EC_{80}$), 80% effective concentration, ZymoGenetics, Inc. A493F). Serum-starved cells were incubated with 150 µl of SFM, 0.4 nM PDGF-BB in SFM, or the titrated a PDGFRβ molecules with 0.4 nM PDGF-BB in SFM. After 18-24 hours, 1 µCi $^3$H-thymidine (Amersham) was added to each well and cells were incubated as normal for 3-6 hours. Cells were harvested onto filter plates and incorporation of $^3$H-thymidine was determined using a Packard Topcount machine.

Results: scFvs, Fabs, and BiAbs showed potent neutralization of pericyte proliferation induced by PDGF-BB as shown by low nM $IC_{50}$ values in Tables 19 and 20 below.

TABLE 19

Anti-PDGFRβ scFv Neutralizing Activity in Pericyte Proliferation Assay

| scFvs and controls | Proliferation IC50 (nM) |
|---|---|
| 162.6262 IgG | 0.05-3 |
| 162.6262 Fab | 20-80 |
| c597.1_2 | 109.1 |
| c613.1_1 | 6.63 |
| c624.1_1 | Inactive |
| c973 | 38.5 |
| c972 | 0.004 |
| c1035 | 33.73 |
| c1014 | NC* |
| c949 | 30.46 |
| c1226 | NC |
| c947 | 82.74 |
| c951 | 65.13 |
| c971 | Inactive |
| c1244 | NC |
| c993 | NC |
| c975 | 4.02 |
| c946 | 142 |
| c941 | 12.69 |
| c1245 | NC |
| c939 | 36.74 |
| c1318 | NC |

*NC = Not calculatable

TABLE 20

Anti-PDGFRβ IgG and BiAb Neutralizing Activity in Pericyte Proliferation Assay

| IgGs and BiAbs | Proliferation IC50 (nM) |
|---|---|
| c597.1_1 | 0.51 |
| c613.1_2 | ND |
| c600.1_1 | 0.73 |
| A2100F (c868) | 3.16 |
| A2097F (c870) | 1.25 |
| A2099F (c1039) | 1.69 |

TABLE 20-continued

Anti-PDGFRβ IgG and BiAb Neutralizing
Activity in Pericyte Proliferation Assay

| IgGs and BiAbs | Proliferation IC50 (nM) |
|---|---|
| A2101F (c1081) | 2.18 |
| A2098F (c1092) | 1.1 |
| A2096F (c1111) | 0.9 |
| c597.1_1 (A2104) | 2.5 |
| 162.6262/bevacizumab Biab | 3.3 |

Example 24

Cloning of Full-length PDGFRβ from Cynomolgus Monkeys

Cynomolgus monkey PDGFRβ (CnPDGFRβ) was cloned by PCR using a high fidelity thermostable polymerase (PFU Ultra, Stratagene Corp, La Jolla Calif.). Based on available sequence information from the UCSC Genome Browser for chimp and human PDGFRβ, oligonucleotides 58399 (AGGACTTCCTGGAGGGGGTGA; SEQ ID NO:489) and 58400 (GAGCTTCAGGCAGGGCAGGGT; SEQ ID NO:490) were designed to amplify the cynomologus gene open reading frame from an in house cynomolgus spleen cDNA library. PCR products from multiple PCR reactions were cloned into PCR4 TO (Invitrogen corp. Carlsbad, Calif.) for sequence comparisons. A nucleotide consensus sequence (SEQ ID NO:491) was obtained from 16 clones.

EXAMPLE 25

Luminex Assay to Determine Cross Reactivity of PDGFRβ scFvs to Cynomolgus PDGFRβ Receptor To screen for cross reactivity of human PDGFRβ scFvs, a Luminex based assay was performed. The assay detects the amount of phosphorylated PDGFRβ that is present in cell lysates. Cynomologus monkey skin cells (CYNOM-K1 cells), (European Collection of Cell Cultures, Wiltshire, UK) were seeded in 96 well flat bottom plates (Falcon, Colorado Springs, Colo.) at a density of 7,500 cells per well in a volume of 100 ul in complete media (Earle's MEM, 10% fetal bovine serum (FBS), 2 mM L-Glutamine, 1% non essential amino acids) for one day at 37° C. and 5% $CO_2$. On day two the cells were switched to media without FBS and serum starved for 24 hours. On day three media was removed from cells and serially diluted scFvs and control monoclonal antibody to PDGFRβ (ZymoGenetics, Inc. E9899) were added in assay media (MEM plus 0.5% bovine serum albumin and 25 mM HEPES) in a volume of 50 ul and incubated for 60 minutes at 37° C. and 5% $CO_2$ PDGF BB (ZymoGenetics, Inc.) was added in 50 ul at 2× concentration to give a final concentration of 0.33 nM ($EC_{80}$, effective concentration at 80 percent) and incubated for 10 minutes at 37° C. and 5% $CO_2$.

The cells were then washed with Bio-Plex Cell Wash Buffer, lysed with lysing solution according to the manufacturer's directions (BioRad, Hercules, Calif.), and the cell supernatants were frozen at −20° C. To thawed cell supernatants, 1× phospho-PDGFRβ beads were added and incubated at room temperature on a shaker for 18 h. Detection antibodies were added to the washed beads and incubated at room temperature on a shaker for 30 minutes, and then streptavidin-PE was incubated with the beads at room temperature for 15 minutes. The beads were resuspended in Bio-Plex Resuspension Buffer and analyzed on a Bio-Plex array reader (Bio-Rad Laboratories).

Results: scFvs, Fabs and IgGs showed potent PDGFR phosphorylation neutralization induced by PDGF-BB as shown by low nM IC50 values in Table 21 below

TABLE 21

Anti-PDGFRβ IgF, scFv, or Fab Neutralizing Activity in Luminex-based Assay Using CYNOM-K1 Cells

| Antibody | IgG, scFv, or Fab | Phosphorylation IC50 (nM) |
|---|---|---|
| c597.1_1 | IgG | <0.1 |
| c613.1_2 | IgG | 1.4 |
| c600.1_1 | IgG | 0.1 |
| 162.6262 | IgG | no effect |
| 163.3111 | IgG | <0.1 |
| c613.1_1 | Fab | 10 |
| c1035 | scFv | 0.2 |
| c949 | scFv | 0.7 |
| c941 | scFv | <0.1 |

EXAMPLE 26

Luminex Assay to Determine Cross Reactivity of Anti-PDGFRβ scFvs to Mouse PDGFRβ

To screen for cross reactivity of human PDGFRβ scFvs, a Luminex based assay was performed. The assay detects the amount of phosphorylated PDGFRβ that is present in cell lysates. Murine embryonic fibroblasts (3T3-Swiss albino, Swiss; American Type Culture Collection, Manassas, Va.) were seeded in 96 well flat bottom plates (Falcon, Colorado Springs, Colo.) at a density of 1,000 cells per well in a volume of 100 ul in complete media (Dulbecco's Modified Eagle Medium (DMEM), 5% fetal bovine serum (FBS)) and incubated at 37° C. in 5% $CO_2$. After 24-48 hours, complete media was replaced with DMEM-F12 (1:1) media with 1× insulin-transferrin-selenium (serum-free media, SFM; Invitrogen, Carlsbad, Calif.) and cells were incubated as before for an additional 18-24 hours. PDGFRβ-neutralizing molecules (scFvs, Fabs), a control monoclonal antibody against PDGFRβ (ZymoGenetics, Inc. E9899), or the Fab fragment of the E9899 monoclonal antibody (ZymoGenetics, Inc.) were serially diluted 1:4 from 2000 nM to 0.02 nM in SFM. Serum-starved cells were incubated with 150 μl of SFM or the titrated a PDGFRβ molecules in SFM for 1 hour at 37° C. in 5% $CO_2$. Cells were then pulsed with 50 μl 1.6 nM PDGF-BB (ZymoGenetics, Inc.; 0.4 nM final concentration, $EC_{80}$, 80% effective concentration) for 10 minutes at 37° C. in 5% $CO_2$. Control wells without PDGF-BB stimulation were included. The cells were then washed with Bio-Plex Cell Wash Buffer and lysed in Lysis Buffer supplied in the assay kit according to the manufacturer's directions (Bio-Rad, Hercules, Calif.), and the cell supernatants were frozen at −20° C. To thawed cell supernatants, 1× phospho-PDGFRβ beads were added and incubated at room temperature on a shaker for 18 h. Detection antibody was added to the washed beads and incubated at room temperature on a shaker for 30 minutes, and then streptavidin-PE was incubated with the beads at room temperature for 15 minutes. The beads were resuspended in Bio-Plex Resuspension Buffer and analyzed on a Bio-Plex array reader (Bio-Rad Laboratories).

EXAMPLE 27

Immuno-fluorescence Based Internalization Assay for Measuring the Effect of PDGFRβ/VEGFA Antagonists on Receptor Internalization Material and Methods Low passage Human Brain Vascular Pericytes (HBVP) (ScienCell Research, San Diego, Calif.) are plated at sub-confluency on 4 chamber glass Lab-TekII chamber slides (catalog #15917 Nalge Nunc, Naperville, Ill.) at volume of 500 ul/chamber in complete media (ScienCell Pericyte Media (PM) plus ScienCell supplements Fetal Bovine Serum, Pericyte Growth Supplement, and Penicillin-Streptomycin). Chamber slides are incubated at 37° and 5% $CO_2$ for 1-2 days until they reach approximately 75% confluency. The binding of PDGFRβ/VEGFA antagonists and control antibody are done at 4°, so all slides are placed on ice and washed one time with cold DMEM+0.1% BSA. The PDGFRβ/VEGFA antagonists and test antibody are then diluted to 1 ug/ml in binding buffer consisting of DMEM+ 3% BSA and Hepes buffer. Each slide is configured so that two antagonists, one control antibody and one control well for secondary antibody only are designated for each chamber slide. 500 ul/well of antagonists, control, or media only is added to each chamber slide. Following a one hour incubation, the TO slide is fixed by washing with cold PBS one time and adding 1 ml/well paraformaldehyde solution. This TO slide measures receptor expression on the cell surface and the slides incubated at 37° C. measure receptor internalization over time. The remaining slides are put in the 37° incubator and removed and fixed in a similar fashion at thirty minutes, ninety minutes, four hour and six hour time points. All slides are kept on ice after fixation. Once all of the slides have been fixed, they are washed one time with PBS and permeabilized for two minutes with −20° C. MetOH. The slides are washed again with cold PBS. From now on the staining is done at room temperature. The slides are incubated at room temperature for five minutes in 50 mM Glycine made up in PBS. The glycine is removed and washed off with PBS, and the slides are blocked in 10% normal goat serum in PBS (#S-1000, Vector Labs, Inc. Burlingame, Calif.), 500 ul/well for thirty minutes. Following the blocking step, 500 ul/well of the secondary antibodies are added to every well. Alexafluor 488 goat anti-mouse (Cat. # A11029, Molecular Probes, Eugene, Oreg.), or Alexafluor 488 goat anti-human (Cat. # A11013, Molecular Probes, Eugene, Oreg.) are diluted 1:150 in wash buffer consisting of PBS+0.1% Tween 20 and 0.1% BSA. The slides are incubated in the dark at room temperature for forty-five minutes. Each slide is washed three times by soaking in PBS for 5 minutes at room temperature. One drop of Vectashield mounting medium with DAPI stain is added to each chamber (Cat. # H-1200, Vector Labs, Inc., Burlingame Calif.) and the slides are coverslipped and examined under the fluorescent microscope. Metavue software is used to visualize the two-color staining profile.

EXAMPLE 28

FcRn Binding Assay for Measuring Binding of PDGFRβ/VEGF-A Antagonists to FcRn at pH 6.0 and pH 7.4

Materials and Methods

Two plates are set up with PDGFRβ/VEGFA antagonists and control antibodies: one to wash at pH 6.0 and one to wash at pH 7.4. Day 1: Two Nunc Maxisorp 96 well elisa plates (cat #44-2404) are coated with 300 ng/well NeutrAvidin (Pierce Chemical Co. cat. #31000) made up in 100 mM $NaHCO_3$, pH 9.3. Plates are incubated at 4° C. overnight. Day 2: The plates are washed 5 times with 0.1% Tween-20/ PBS (PBST). The plates are then blocked with 250 ul/well of blocking buffer containing 0.8% NaCl, 0.02% KCl, 0.102% $Na_2HPO_4$, 0.02% $KH_2PO_4$, 1% BSA, 0.05% Polysorbate, 0.05% Proclin 300 pH 7.2, for one hour at room temperature. The plates are then washed 2 times with PBST. Each well is then coated with 150 ng of biotinylated FCRN protein (produced in-house) diluted in PBST+1% BSA. Plates are incubated at room temperature for one hour. PDGFRβ/VEGFA antagonists and control antibodies (Herceptin, for example) are diluted in 100 mM $NaPO_4$, 0.05% Tween 20 (v/v), +0.1% BSA adjusted to pH 6.0 (pH 6.0 buffer) at concentrations ranging from 150 nM to 0.07 nM. Samples are tested in duplicate at a volume of 50 ul/well of each concentration. pH 6.0 buffer only is run as a control to determine the background levels on each plate. Plates are incubated at room temperature for two hours. After the binding step, each plate is washed in separate buffers: one plate is washed with 250 ul/well of pH 6.0 buffer, and one plate is washed with 250 ul/well of 100 mM $NaPO_4$, 0.05% Tween 20 (v/v), 0.1% BSA adjusted to pH 7.4 (pH 7.4 buffer). Plates are incubated in wash buffers at room temperature for a total of one hour with a wash step performed every twenty minutes. Following the wash steps, the bound antibody is detected with 100 ul/well of HRP goat anti-human IgG F(ab)$_2$ fragment Fc gamma specific secondary antibody (Jackson Immunoresearch Cat. #109-036-098). The secondary antibody is diluted 1:5,000 in the pH 6.0 buffer, and the incubation is done for one hour at room temperature. Plates are then washed 5 times with PBST. Finally, 100 ul of TMB (TMBW-1000-01, BioFX Laboratories) is added to each well, and the plates are developed at room temperature for approximately three minutes. At this point, 100 μl/well of stop buffer (STPR-100-01, BioFX Laboratories) is added to quench the reaction. The plates are read on a spectrophotometer at a wave length of 450/570 nm. OD values are examined to compare binding patterns at pH 6.0 and release patterns at pH 7.4.

EXAMPLE 29

Construction of Anti-PDGFRβ/VEGF-A Bispecific Molecule Panel

A. Overview

Exemplary expression construct formats for an anti-PDGFRβ/VEGF-A bispecific molecule include tandem single chain FvFcs (tascFvFcs), bi-single chain FvFcs (biscFvFcs), and biAbs. The definitions of these molecular formats are as follows: A tascFvFc has two scFvs side by side connected by a tether and fused directly to an Fc. A biscFvFc has both an amino-terminal and carboxyl-terminal scFv fused to a Fc with the carboxyl-terminal connected via a linker. Both tascFvFcs and biscFvFcs, for the purposes of this example, have an effector function minus Fc (Fc5) (SEQ ID NO:492). A biAb is a whole immunoglobulin with a carboxyl-terminal scFv connected via a linker. In the case of biAbs described in this example, the heavy chain used was an effector function minus human gamma1 (IgG1.1) and the light chain constant regions were kappa. These molecules are shown in FIG. 2.

For the purposes of describing tandem single chain Fv molecules, a tether is defined as a polypeptide that connects two single chain Fvs and the linker refers to the polypeptide that connects the two variable domains comprising a single chain Fv and to any polypeptide linking an scFv to an Fc or immunoglobulin heavy chain. The linker sequence used in the scFv molecules described in this Example is $(G_4S)_5$ (SEQ ID NO:494). The tether sequence used for tascFvFcs is typically $(G_4S)_2$ (SEQ ID NO:496). The carboxyl-terminal linker used to connect scFvs to Fc in the bisc and biAb format is the same as the tether sequence for the tascFvFcs. The scFv sequences were fused to Fc5, a modified form of human gamma1 Fc that is effector minus for the biscFvFcs. The scFv sequences were fused to IgG1.1, an effector function minus whole human immunoglobulin gamma1 for the biAbs.

Tandem Single Chain FvFc Construction

Single chain Fv PCR fragments are each constructed by overlapping two PCR fragments, one each for the variable heavy and variable light regions with the internal overlap region in the 25mer $(G_4S)_5$ linker.

Two PCR fragments are generated, one for each scFv and assembled into tandem scFvFcs by the following method: The scFv at the 5' end has oligo sequence overlapping mouse 26-10 VH signal sequence and with tether region between the two scFvs. The 3' scFv has oligo sequence overlapping the tether and the Fc5 fusion partner. Each scFv fragment is assembled by PCR. The scFv fragments are assembled into a tandem scFv and inserted at the NotI site of pZMP31-ms 26-10VH-Fc5 by yeast recombination as described below.

The PCR amplification reaction conditions are as follows: 1 cycle, 95° C., 2 minutes; 30 cycles, 95° C., 15 seconds, followed by 55° C., 30 seconds, followed by 68° C., 1 minute per kb. The PCR reaction mixture is run on a 1% agarose gel and the DNA fragment corresponding to the expected size is extracted from the gel using the GE Healthcare Illustra GFX™ PCR DNA and Gel Band Purification Kit (United Kingdom).

The cDNAs are cloned into the vector pZMP31-ms 26-10VH-Fc5 (SEQ ID NO:648) for tandem single chain FvFcs (tascFv-Fcs) by yeast recombination. The vector pZMP31-ms 26-10VH-Fc5 is derived from pZMP31 (SEQ ID NO:647) by the addition of mouse 26-10 VH signal sequence and Fc5 with a NotI restriction site between for insertion of cDNA. pZMP31 is a mammalian expression vector containing an expression cassette having the chimeric CMV enhancer/MPSV promoter, a EcoRI site for linearization for insertion of cDNA, a poliovirus internal ribosome entry site (IRES), a DHFR cDNA, the SV40 terminator, an E. coli origin of replication, and S. cerevisiae URA3 and CEN-ARS genes. This vector is derived from pZMP21 (U.S. Pat. No. 7,262,025).

Prior to recombination in yeast with the gel-extracted PCR fragments, the pZMP31-ms 26-10VH-Fc5 plasmid is digested with NotI. 100 µl of electrocompetent yeast (S. cerevisiae SF838-9D, URA-) are combined with approximately 12 µl of each gel-extracted an PCR fragments and approximately 100 ng of NotI digested pZMP31-ms 26-10VH-Fc5 vector. The mix is transferred to a 0.2 cm electroporation cuvette. The yeast/DNA mixture is electropulsed using power supply (BioRad Laboratories, Hercules, Calif.) settings of 0.75 kV (5 kV/cm), co ohms, and 25 µF. Six hundred µl of 1.2 M sorbitol are added to the cuvette, and the yeast are plated in 300 µl aliquots onto two URA-D plates and incubated at 30° C. After about 72 hours, the Ura+ yeast transformants from a single plate are resuspended in 1 ml H₂O and spun briefly to pellet the yeast cells. The cell pellet is resuspended in 0.5 ml of lysis buffer (2% Triton X-100, 1% SDS, 100 mM NaCl, 10 mM Tris, pH 8.0, 1 mM EDTA). The 500 µl of the lysis mixture is added to an Eppendorf tube containing 250 µl acid-washed glass beads and 300 µl phenol-chloroform, is vortexed for 3 minutes, and spun for 5 minutes in an Eppendorf centrifuge at maximum speed. Three hundred µl of the aqueous phase is transferred to a fresh tube, and the DNA is precipitated with 600 µl ethanol, followed by centrifugation for 30 minutes at maximum speed. The tube is decanted and the pellet is washed with 1 mL of 70% ethanol. The tube is decanted and the DNA pellet is resuspended in 10 µl water.

Transformation of electrocompetent E. coli host cells (DH10B, Invitrogen, Carlsbad, Calif.) is done using 1 µl of the yeast DNA preparation and 20 µl of E. coli cells. The cells are electropulsed at 2.0 kV, 25 µF, and 400 ohms. Following electroporation, 1 ml SOC (2% Bacto™ Tryptone (Difco, Detroit, Mich.), 0.5% yeast extract (Difco), 10 mM NaCl, 2.5 mM KCl, 10 mM MgCl₂, 10 mM MgSO₄, 20 mM glucose) are added and the cells are plated in 50 µl and 200 µl aliquots on two LB AMP plates (LB broth (Lennox), 1.8% Bacto™ Agar (Difco), 100 mg/L Ampicillin).

The plasmid is extracted from six E. coli clones for each construct, subjected to sequence analysis and one clone containing the correct sequence was selected for further use. Large-scale plasmid DNA is isolated using a commercially available kit (QIAGEN Plasmid Mega Kit, Qiagen, Valencia, Calif.) according to manufacturer's instructions.

A. BiAb Construction

1. Initial BiAb Panel

Single chain Fv PCR fragments were each constructed by overlapping two PCR fragments, one each for the variable heavy and variable light regions with the internal overlap region in the 25mer $(G_4S)_5$ linker.

a. Fab to IgG Conversion c597 Fab sequence was amplified by PCR from the pMID display construct using primers zc60375 (SEQ ID NO:645) and zc60376 (SEQ ID NO:646) in the following conditions: 1 cycle, 95° C., 2 minutes; 25 cycles, 95° C., 30 seconds, followed by 50° C., 30 seconds, followed by 68° C., 90 seconds; 1 cycle, 68° C., 5 minutes. The PCR reaction was purified using a QIAquick PCR Purification kit (QIAGEN) followed by digestion with ApaLI and NheI (New England Biolabs), incubated at 37° C. overnight. The digestion reaction was run on a 1.2% agarose gel (Invitrogen) and the 1.1 kb DNA fragment was extracted from the gel using the QIAquick Gel Extraction kit (QIAGEN).

The fragment was ligated into phosphatased (Promega) ApaLI- and NheI-cut pRH1az (Dyax) using T4 DNA Ligase (NEB), incubating overnight at 16° C., followed by heat-inactivation for 10 minutes at 65° C. The ligation reaction was NaOAc/Ethanol precipitated and resuspended in 20 ul H₂O.

50 µl DH5α Competent cells (Invitrogen) were transformed with 4 µl of the ligation via heat shock as per the manufacturers protocol, then plated onto agar plates (2×YT, 2% glucose, 10 ug/ml Ampicillin) and grown overnight at 37° C.

Plasmid was prepared from a single colony using QIAGEN QIAprep Spin Miniprep kit, then sequentially digested with AscI and MfeI; each digest followed by purification with QIAquick PCR Purification kit. The 6.9 kb DNA fragment was phosphatased (Promega), run on a 1.2% agarose gel (Invitrogen) and extracted from the gel using the QIAquick Gel Extraction kit.

A ligation reaction containing this intermediate vector and a 692 by fragment that had been previously digested from pShuttle (Dyax) using AscI and MfeI (NEB) then purified with QIAquick PCR Purification kit was performed as previously described.

The ligation reaction was NaOAc/Ethanol precipitated and resuspended in 20 µl H₂O.

75 µl DH5α Competent cells (Invitrogen) were transformed with 2 µl of the ligation via heat shock as per the manufacturers protocol, then plated onto agar plates (2×YT, 2% glucose, 100 ug/ml Ampicillin) and grown overnight at 37° C.

Plasmid was isolated from 4 colonies using QIAprep Spin Miniprep kit and subjected to sequence analysis. A single clone containing the correct sequence was selected for large scale plasmid DNA preparation (EndoFree Plasmid Maxi Kit, QIAGEN).

b. Insertion of C-terminal scFv

The c597.1 immunoglobulin gamma1/pRH1az (open reading frame shown in SEQ ID NO:536 and SEQ ID NO:509) plasmid already contained the anti-PDGFRβ antibody and was linearized at the 3' end of the heavy chain to insert the anti-VEGF-A single chain Fvs: c1111.1 contained in SEQ ID NO:495, c870.1 contained in SEQ ID NO:497, c1092.1 contained in SEQ ID NO:499, 1039.1 contained in SEQ ID NO:501, c868.1 contained in SEQ. ID NO:503, and c1081.1 contained in SEQ ID NO:505. Two PCR fragments were generated to add the carboxyl terminal scFv and were joined together via overlap PCR. The first PCR used a 5' oligonucleotide which overlapped the BsrGI site in the immunoglobulin gamma1 Fc region and the 3' oligo overlapped the (G₄S)₂ linker. The second PCR fragment used a 5' oligonucleotide that overlapped at the (G₄S)₂ linker region and contained the scFv fragment. The 3' oligonucleotide overlapped the BclI site in the vector backbone.

The PCR amplification reaction conditions were as follows: 1 cycle, 95° C., 2 minutes; 30 cycles, 95° C., 15 seconds, followed by 55° C., 30 seconds, followed by 68° C., 1 minute per kb. The PCR reaction mixture was run on a 1% agarose gel and the DNA fragment corresponding to the expected size was extracted from the gel using the GE Healthcare Illustra GFX™ PCR DNA and Gel Band Purification Kit (United Kingdom).

The PCR fragments generated by overlap PCR were digested with BsrGI and BclI. The fragments were ligated into c597.1 immunoglobulin gamma1/pRH1az (a commercial Dyax vector backbone) which was previously digested with the same enzymes, using T4 DNA ligase (Invitrogen, Carlsbad, Calif.). The ligations were incubated overnight at 16° C. and were heat-treated for 10 minutes at 65° C.

Transformation of chemical competent E. coli host cells (DH10B-T1, Invitrogen, Carlsbad, Calif.) was performed using 1 µl of the ligated DNA preparation and 20 µl of E. coli cells. The cells were transformed according to product manual and then plated in 50 µl and 200 µl aliquots on two LB AMP plates (LB broth (Lennox), 1.8% Bacto™ Agar (Difco), 100 mg/L Ampicillin).

Plasmid was prepared from four colonies per construct and subjected to sequence analysis. At least one clone containing the correct sequence was selected for further use. Large-scale plasmid DNA was isolated using a commercially available kit (QIAGEN Plasmid Mega Kit, Qiagen, Valencia, Calif.) according to manufacturer's instructions.

Oligonucleotide primers and templates for construction of each biAb are summarized in Table 22.

TABLE 22

| BiAb Construction - Heavy Chain with C-Terminal scFv* | | | | |
|---|---|---|---|---|
| MVC#/ Nucleotide SEQ ID NO:/ Polypeptide SEQ ID NO:** | Oligonucleotide primers zc# | Template IgG1 (MVC376) | Oligonucleotide primers zc# | Template Cluster ID |
| MVC# 334/ | 5' = 56959 (SEQ ID NO: 523) | IgG1 | 5' = 60525 (SEQ ID NO: 524) | c1111.1 |
| SEQ ID NO: 511/SEQ ID NO: 512 | 3' = 60566 (SEQ ID NO: 525) | SEQ ID NO: 509 | 3' = 61084 (SEQ ID NO: 526) | SEQ ID NO: 497 |
| MVC# 335/ | 5' = 56959 (SEQ ID NO: 523) | IgG1 | 5' = 60525 (SEQ ID NO: 524) | c870.1 |
| SEQ ID NO: 513/SEQ ID NO: 514 | 3' = 60566 (SEQ ID NO: 525) | SEQ ID NO: 509 | 3' = 61085 (SEQ ID NO: 527) | SEQ ID NO: 499 |
| MVC# 336/ | 5' = 56959 (SEQ ID NO: 523) | IgG1 | 5' = 60525 (SEQ ID NO: 524) | c1092.1 |
| SEQ ID NO: 515/SEQ ID NO: 516 | 3' = 60566 (SEQ ID NO: 525) | SEQ ID NO: 509 | 3' = 61086 (SEQ ID NO: 528) | SEQ ID NO: 501 |
| MVC# 337/ | 5' = 56959 (SEQ ID NO: 523) | IgG1 | 5' = 60525 (SEQ ID NO: 524) | c1039.1 |
| SEQ ID NO: 517/SEQ ID NO: 518 | 3' = 60566 (SEQ ID NO: 525) | SEQ ID NO: 509 | 3' = 61086 (SEQ ID NO: 528) | SEQ ID NO: 503 |
| MVC# 338/ | 5' = 56959 (SEQ ID NO: 523) | IgG1 | 5' = 61089 (SEQ ID NO: 530) | c868.1 |
| SEQ ID NO: 519/SEQ ID NO: 520 | 3' = 60566 (SEQ ID NO: 525) | SEQ ID NO: 509 | 3' = 61087 (SEQ ID NO: 529) | SEQ ID NO: 505 |
| MVC# 339/ | 5' = 56959 (SEQ ID NO: 523) | IgG1 | 5' = 60525 (SEQ ID NO: 524) | c1081.1 |
| SEQ ID NO: 521/SEQ ID NO: 522 | 3' = 60566 (SEQ ID NO: 525) | SEQ ID NO: 509 | 3' = 61086 (SEQ ID NO: 528) | SEQ ID NO: 507 |

*All biAbs have the same c597.1 light chain sequence (nucleotide and polypeptide sequences shown in SEQ ID NOs: 536 and 537, respectively). The signal sequence of the c597.1 light chain component of the biAbs corresponds to amino acids 1-19 of SEQ ID NO: 537 (encoded by nucleotides 1-57 of SEQ ID NO: 536.
**Constructs MVC# 334-339 are wild-type human IgG1 (comprising heavy chain variable region of c597) with a carboxyl-terminal scFv connected via a linker. The signal sequence of the IgG1-scFv component corresponds to amino acids 1-19 of the indicated polypeptide SEQ ID NO. (corresponding to nucleotides 1-57 of the indicated nucleotide SEQ ID NO.)

2. Second BiAb Panel

Single chain Fv PCR fragments were each constructed by overlapping two PCR fragments, one each for the variable heavy and variable light regions with the internal overlap region in the 25mer (G₄S)₅ linker.

a. Fab to IgG Conversion

For each of c597 and c600 Fabs, Fab sequence was amplified by PCR from the pMID display construct using primers zc60375 (SEQ ID NO:645) and zc60376 (SEQ ID NO:646) in the following conditions: 1 cycle, 95° C., 2 minutes; 25 cycles, 95° C., 30 seconds, followed by 50° C., 30 seconds, followed by 68° C., 90 seconds; 1 cycle, 68° C., 5 minutes. The PCR reaction was purified using a QIAquick PCR Purification kit (QIAGEN) followed by digestion with ApaLI and NheI (New England Biolabs), incubated at 37° C. overnight. The digestion reaction was run on a 1.2% agarose gel (Invitrogen) and the 1.1 kb DNA fragment was extracted from the gel using the QIAquick Gel Extraction kit (QIAGEN).

(375) The fragment was ligated into phosphatased (Promega) ApaLI- and NheI-cut pRH1az (Dyax) using T4 DNA Ligase (NEB), incubating overnight at 16° C., followed by heat-inactivation for 10 minutes at 65° C. The ligation reaction was NaOAc/Ethanol precipitated and resuspended in 20 ul H₂O.

50 µl DH5α Competent cells (Invitrogen) were transformed with 4 µl of the ligation via heat shock as per the manufacturers protocol, then plated onto agar plates (2×YT, 2% glucose, 100 ug/ml Ampicillin) and grown overnight at 37° C.

Plasmid was prepared from a single colony using QIAGEN QIAprep Spin Miniprep kit, then sequentially digested with AscI and MfeI; each digest followed by purification with QIAquick PCR Purification kit. The 6.9kb DNA fragment was phosphatased (Promega), run on a 1.2% agarose gel (Invitrogen) and extracted from the gel using the QIAquick Gel Extraction kit.

A ligation reaction containing this intermediate vector and a 692 by fragment that had been previously digested from pShuttle (Dyax) using AscI and MfeI (NEB) then purified with QIAquick PCR Purification kit was performed as previously described.

The ligation reaction was NaOAc/Ethanol precipitated and resuspended in 20 µl $H_2O$.

75 µl DH5α Competent cells (Invitrogen) were transformed with 2 µl of the ligation via heat shock as per the manufacturers protocol, then plated onto agar plates (2×YT, 2% glucose, 100 ug/ml Ampicillin) and grown overnight at 37° C.

Plasmid was isolated from 4 colonies using QIAprep Spin Miniprep kit and subjected to sequence analysis. A single clone containing the correct sequence was selected for large scale plasmid DNA preparation (EndoFree Plasmid Maxi Kit, QIAGEN).

b. Insertion of C-terminal scFv

The c597.1 immunoglobulin gamma1/pRH1az (open reading frame shown in SEQ ID NO:536 and SEQ ID NO:509) or c600.1 1 immunoglobulin gamma1/pRH1az (open reading frame shown in SEQ ID NO:613 and SEQ ID NO:615) plasmids already contained the anti-PDGFRβ antibody and was linearized at the 5' end of the heavy chain at the NheI site to insert the anti-VEGFA single chain Fvs: c868.1 contained in SEQ ID NO:607, c870.1 contained in SEQ ID NO:609, 1039.1 contained in SEQ ID NO:611. Two PCR fragments were generated to add the carboxyl terminal scFv and were joined together via overlap PCR. The first PCR used a 5' oligonucleotide which overlapped the NheI site in the immunoglobulin gamma1 to make it immunoglobulin gamma 1.1 Fc region (SEQ ID NO:641) and the 3' oligo overlapped the $(G_4S)$, linker. The second PCR fragment used a 5' oligonucleotide that overlapped at the $(G_4S)_2$ linker region and contained the scFv fragment. The 3' oligonucleotide overlapped the BclI site in the vector backbone. The PCR amplification reaction conditions were as follows: 1 cycle, 95° C., 2 minutes; 30 cycles, 95° C., 15 seconds, followed by 55° C., 30 seconds, followed by 68° C., 1 minute per kb. The PCR reaction mixture was run on a 1% agarose gel and the DNA fragment corresponding to the expected size was extracted from the gel using the GE Healthcare Illustra GFX™ PCR DNA and Gel Band Purification Kit (United Kingdom).

The PCR fragments generated by overlap PCR were digested with NheI and BclI. The fragments were ligated into c597.1 immunoglobulin gamma1/pRH1az or c600.1 immunoglobulin gamma1/pRH1az (a commercial Dyax vector backbone) which was previously digested with the same enzymes, using T4 DNA ligase (Invitrogen, Carlsbad, Calif.). The ligations were incubated for one hour at room temperature and were heat-treated for 10 minutes at 65° C.

Transformation of chemical competent *E. coli* host cells (DH10B-T1, Invitrogen, Carlsbad, Calif.) was performed using 1 µl of the ligated DNA preparation and 20 µl of *E. coli* cells. The cells were transformed according to product manual and then plated in 50 µl and 200 µl aliquots on two LB AMP plates (LB broth (Lennox), 1.8% Bacto™ Agar (Difco), 100 mg/L Ampicillin).

Plasmid was prepared from four colonies per construct and subjected to sequence analysis. At least one clone containing the correct sequence was selected for further use. Large-scale plasmid DNA was isolated using a commercially available kit (QIAGEN Plasmid Mega Kit, Qiagen, Valencia, Calif.) according to manufacturer's instructions.

Oligonucleotide primers and templates for construction of each biAb are summarized in Table 23.

TABLE 23

BiAb Construction - Heavy Chain with C-Terminal scFv*

| MVC#/(IgG heavy chain) Nucleotide SEQ ID NO:/ Polypeptide SEQ ID NO:** | Oligonucleotide primers zc# | Template IgG1.1 | Oligonucleotide primers zc# | Template Cluster ID |
|---|---|---|---|---|
| MVC# 486/(c597.1) SEQ ID NO: 629/ SEQ ID NO: 630 | 5' = 62580 (SEQ ID NO: 601) 3' = 60566 (SEQ ID NO: 525) | IgG1.1 (SEQ ID NO: 641) | 5' = 61089 (SEQ ID NO: 530) 3' = 61087 (SEQ ID NO: 529) | c868.1 SEQ ID NO: 607 |
| MVC# 487/(c597.1) SEQ ID NO: 631/ SEQ ID NO: 632 | 5' = 62580 (SEQ ID NO: 601) 3' = 60566 (SEQ ID NO: 525) | IgG1.1 (SEQ ID NO: 641) | 5' = 60525 (SEQ ID NO: 524) 3' = 62593 (SEQ ID NO: 602) | c870.1 SEQ ID NO: 609 |
| MVC# 488/(c597.1) SEQ ID NO: 633/ SEQ ID NO: 634 | 5' = 62580 (SEQ ID NO: 601) 3' = 60566 (SEQ ID NO: 525) | IgG1.1 (SEQ ID NO: 641) | 5' = 60525 (SEQ ID NO: 524) 3' = 61086 (SEQ ID NO: 528) | c1039.1 SEQ ID NO: 611 |
| MVC# 489/(c600.1) SEQ ID NO: 635/ SEQ ID NO: 636 | 5' = 62580 (SEQ ID NO: 601) 3' = 60566 (SEQ ID NO: 525) | IgG1.1 (SEQ ID NO: 641) | 5' = 61089 (SEQ ID NO: 530) 3' = 61087 (SEQ ID NO: 529) | c868.1 SEQ ID NO: 607 |
| MVC# 490/(c600.1) SEQ ID NO: 637/ SEQ ID NO: 638 | 5' = 62580 (SEQ ID NO: 601) 3' = 60566 (SEQ ID NO: 525) | IgG1.1 (SEQ ID NO: 641) | 5' = 60525 (SEQ ID NO: 524) 3' = 62593 (SEQ ID NO: 602) | c870.1 SEQ ID NO: 609 |
| MVC# 491/(c600.1) SEQ ID NO: 639/ SEQ ID NO: 640 | 5' = 62580 (SEQ ID NO: 601) 3' = 60566 (SEQ ID NO: 525) | IgG1.1 (SEQ ID NO: 641) | 5' = 60525 (SEQ ID NO: 524) 3' = 61086 (SEQ ID NO: 528) | c1039.1 SEQ ID NO: 611 |

*All biAbs have the same light chain sequence (nucleotide and polypeptide sequences shown in SEQ ID NOs: 536 and 537, respectively, or SEQ ID NOs: 613 and 614, respectively). The signal sequence of the c597.1 or c600.1 light chain component of the biAbs corresponds to amino acids 1-19 of SEQ ID NO: 537 or SEQ ID NO: 613 (encoded by nucleotides 1-57 of SEQ ID NO: 536 or SEQ ID NO: 614).
**Constructs MVC# 486-491 are effector-function-negative human IgG1 ("IgG1.1") (comprising heavy chain variable region of c597 or c600, as indicated) with a carboxyl-terminal scFv connected via a linker. The signal sequence of the IgG1.1-scFv component corresponds to amino acids 1-19 of the indicated polypeptide SEQ ID NO. (corresponding to nucleotides 1-57 of the indicated nucleotide SEQ ID NO.)

C. Construction of Bi-Single Chain FvFcs (BiscFvFvs)

1. General

Single chain Fv PCR fragments were each constructed by overlapping two PCR fragments, one each for the variable heavy and variable light regions with the internal overlap region in the 25mer $(G_4S)_5$ linker.

Three PCR fragments were generated for assembly of a bi-single chain FvFc (biscFvFc) molecule. The scFv at the 5' end had the mouse 26-10 VH signal sequence added via oligo design and overlapped with the 5' untranslated region of the vector and with the Fc region. The second PCR fragment consisted of the Fc5 fragment, which overlapped with the linker sequence which connects the carboxyl terminal scFv to the Fc region. The 3' scFv overlapped the linker sequence on the carboxyl terminus of the Fc and the polio virus IRES (internal ribosomal entry site).

The PCR amplification reaction conditions were as follows: 1 cycle, 95° C., 2 minutes; 30 cycles, 95° C., 15 seconds, followed by 55° C., 30 seconds, followed by 68° C., 1 minute per kb. The PCR reaction mixture was run on a 1% agarose gel and the DNA fragment corresponding to the expected size was extracted from the gel using the GE Healthcare Illustra GFX™ PCR DNA and Gel Band Purification Kit (United Kingdom).

The cDNAs were cloned into the vector pZMP31 by yeast recombination. pZMP31 is a mammalian expression vector containing an expression cassette having the chimeric CMV enhancer/MPSV promoter, a EcoRI site for linearization for insertion of cDNA, a poliovirus internal ribosome entry site (IRES), a DHFR cDNA, the SV40 terminator, an *E. coli* origin of replication, and *S. cerevisiae* URA3 and CEN-ARS genes. This vector was derived from pZMP21 (U.S. Pat. No. 7,262,025).

Prior to recombination in yeast with the gel-extracted PCR fragments, the pZMP31 plasmid was digested with EcoRI. 100 µl of electrocompetent yeast (*S. cerevisiae* SF838-9D, URA-) were combined with approximately 12 µl of each gel-extracted PCR fragment and approximately 100 ng of EcoRI-digested pZMP31. The mix was transferred to a 0.2 cm electroporation cuvette. The yeast/DNA mixture was electropulsed using power supply (BioRad Laboratories, Hercules, Calif.) settings of 0.75 kV (5 kV/cm), ∞ ohms, and 25 µF. Six hundred µl of 1.2 M sorbitol was added to the cuvette, and the yeast was plated in 300 µl aliquots onto two URA-D plates and incubated at 30° C. After about 72 hours, the Ura⁺ yeast transformants from a single plate were resuspended in 1 ml H₂O and spun briefly to pellet the yeast cells. The cell pellet was resuspended in 0.5 ml of lysis buffer (2% Triton X-100, 1% SDS, 100 mM NaCl, 10 mM Tris, pH 8.0, 1 mM EDTA). The 500 µl of the lysis mixture was added to an Eppendorf tube containing 250 µl acid-washed glass beads and 300 µl phenol-chloroform, was vortexed for 3 minutes, and spun for 5 minutes in an Eppendorf centrifuge at maximum speed. Three hundred µl of the aqueous phase was transferred to a fresh tube, and the DNA was precipitated with 600 µl ethanol, followed by centrifugation for 30 minutes at maximum speed. The tube was decanted and the pellet was washed with 1 mL of 70% ethanol. The tube was decanted and the DNA pellet was resuspended in 10 µl water.

Transformation of electrocompetent *E. coli* host cells (DH10B, Invitrogen, Carlsbad, Calif.) was done using 1 µl of the yeast DNA preparation and 20 µl of *E. coli* cells. The cells were electropulsed at 2.0 kV, 25 µF, and 400 ohms. Following electroporation, 1 ml SOC (2% Bacto™ Tryptone (Difco, Detroit, Mich.), 0.5% yeast extract (Difco), 10 mM NaCl, 2.5 mM KCl, 10 mM MgCl₂, 10 mM MgSO₄, 20 mM glucose) was added and the cells were plated in 50 µl and 200 µl aliquots on two LB AMP plates (LB broth (Lennox), 1.8% Bacto™ Agar (Difco), 100 mg/L Ampicillin).

The plasmid was extracted from six *E. coli* clones for each construct, subjected to sequence analysis and one clone containing the correct sequence was selected for further use. Large-scale plasmid DNA was isolated using a commercially available kit (QIAGEN Plasmid Mega Kit, Qiagen, Valencia, Calif.) according to manufacturer's instructions.

2. Construction of BiscFvFcs c941/c868, c941/c870, 941/c1039, c1035/c868, c1035/c870, and c1035/c1039

Three PCR fragments were generated for assembly of a bi-single chain FvFc (biscFvFc) molecule. The scFv at the 5' end was either c941.1 contained in SEQ ID NO:603 or c1035.1 contained in SEQ ID NO:605 and had the mouse 26-10 VH signal sequence added via oligo design and overlapped with the 5' untranslated region of the vector and with the Fc region. The second PCR fragment consisted of the Fc5 fragment, which overlapped with the linker sequence which connects the carboxyl terminal scFv to the Fc region. The 3' scFv was either c868.1 contained in SEQ ID NO:607, c870.1 contained in SEQ ID NO:609, or 1039.1 contained in SEQ ID NO:611 and overlapped the linker sequence on the carboxyl terminus of the Fc and the polio virus IRES (internal ribosomal entry site). Oligonucleotide primers and templates for construction of each biscFvFc are summarized in Table 24.

TABLE 24

Construction of Bi-Single Chain FvFcs (BisFvFcs)

| MVC#/ Nucleotide SEQ ID NO:/ Polypeptide SEQ ID NO:* | scFv1 | | | | Fc5 (SEQ ID NO: 643) & zc# | scFv2 | | | |
|---|---|---|---|---|---|---|---|---|---|
| | Oligos zc# | Template | Oligos zc# | Template | | Oligos zc# | Template | Oligos zc# | Template |
| 415/ SEQ ID NO: 617/ SEQ ID NO: 618 | 5' = 56626 (SEQ ID NO: 585) 5' = 60427 (SEQ ID NO: 588) 3' = 61436 (SEQ ID NO: 591) | c941.1 SEQ ID NO: 603 | 5' = 61437 (SEQ ID NO: 592) 3' = 60496 (SEQ ID NO: 589) | c941.1 SEQ ID NO: 603 | Fc5 5' = 24945 (SEQ ID NO: 584) 3' = 60566 (SEQ ID NO: 525) | 5' = 61438 (SEQ ID NO: 593) 3' = 61439 (SEQ ID NO: 594) | c868.1 SEQ ID NO: 607 | 5' = 60139 (SEQ ID NO: 587) 3' = 61445 (SEQ ID NO: 598) | c868.1 SEQ ID NO: 607 |
| 416/ SEQ ID NO: 619/ SEQ ID NO: 620 | 5' = 56626 (SEQ ID NO: 585) 5' = 60427 (SEQ ID NO588) 3' = 61436 (SEQ ID NO: 591) | c941.1 SEQ ID NO: 603 | 5' = 61437 (SEQ ID NO: 592) 3' = 60496 (SEQ ID NO: 589) | c941.1 SEQ ID NO: 603 | Fc5 5' = 24945 (SEQ ID NO: 584) 3' = 60566 (SEQ ID NO: 525) | 5' = 60525 (SEQ ID NO: 524) 3' = 59956 (SEQ ID NO: 586) | c870.1 SEQ ID NO: 609 | 5' = 61440 (SEQ ID NO: 595) 3' = 61447 (SEQ ID NO: 599) | c870.1 SEQ ID NO: 609 |

TABLE 24-continued

Construction of Bi-Single Chain FvFcs (BisFvFcs)

| MVC#/ Nucleotide SEQ ID NO:/ Polypeptide SEQ ID NO:* | scFv1 | | | | Fc5 (SEQ ID NO: 643) & zc# | scFv2 | | | |
|---|---|---|---|---|---|---|---|---|---|
| | Oligos zc# | Template | Oligos zc# | Template | | Oligos zc# | Template | Oligos zc# | Template |
| 417/ SEQ ID NO: 621/ SEQ ID NO: 622 | 5' = 56626 (SEQ ID NO: 585) 5' = 60427 (SEQ ID NO: 588) 3' = 61436 (SEQ ID NO: 591) | c941.1 SEQ ID NO: 603 | 5' = 61437 (SEQ ID NO: 592) 3' = 60496 (SEQ ID NO: 589) | c941.1 SEQ ID NO: 603 | Fc5 5' = 24945 (SEQ ID NO: 584) 3' = 60566 (SEQ ID NO: 525) | 5' = 60525 (SEQ ID NO: 524) 3' = 59956 (SEQ ID NO: 586) | c1039.1 SEQ ID NO: 611 | 5' = 60500 (SEQ ID NO: 590) 3' = 61448 (SEQ ID NO: 600) | c1039.1 SEQ ID NO: 611 |
| 418/ SEQ ID NO: 623/ SEQ ID NO: 624 | 5' = 56626 (SEQ ID NO: 585) 5' = 60427 (SEQ ID NO: 588) 3' = 59956 (SEQ ID NO: 586) | c1035.1 SEQ ID NO: 605 | 5' = 61443 (SEQ ID NO: 596) 3' = 61444 (SEQ ID NO: 597) | c1035.1 SEQ ID NO: 605 | Fc5 5' = 24945 (SEQ ID NO: 584) 3' = 60566 (SEQ ID NO: 525) | 5' = 61438 (SEQ ID NO: 593) 3' = 61439 (SEQ ID NO: 594) | c868.1 SEQ ID NO: 607 | 5' = 60139 (SEQ ID NO: 587) 3' = 61445 (SEQ ID NO: 598) | c868.1 SEQ ID NO: 607 |
| 419/ SEQ ID NO: 625/ SEQ ID NO: 626 | 5' = 56626 (SEQ ID NO: 585) 5' = 60427 (SEQ ID NO: 588) 3' = 59956 SEQ ID NO: 586) | c1035.1 SEQ ID NO: 605 | 5' = 61443 (SEQ ID NO: 596) 3' = 61444 (SEQ ID NO: 597) | c1035.1 SEQ ID NO: 605 | Fc5 5' = 24945 (SEQ ID NO: 584) 3' = 60566 (SEQ ID NO: 525) | 5' = 60525 (SEQ ID NO: 524) 3' = 59956 (SEQ ID NO: 586) | c870.1 SEQ ID NO: 609 | 5' = 61440 (SEQ ID NO: 595) 3' = 61447 (SEQ ID NO: 599) | c870.1 SEQ ID NO: 609 |
| 420/ SEQ ID NO: 627/ SEQ ID NO: 628 | 5' = 56626 (SEQ ID NO585) 5' = 60427 SEQ ID NO: 588) 3' = 59956 (SEQ ID NO: 586) | c1035.1 SEQ ID NO: 605 | 5' = 61443 (SEQ ID NO: 596) 3' = 61444 (SEQ ID NO: 597) | c1035.1 SEQ ID NO: 605 | Fc5 5' = 24945 (SEQ ID NO: 584) 3' = 60566 (SEQ ID NO: 525) | 5' = 60525 (SEQ ID NO: 524) 3' = 59956 (SEQ ID NO: 586) | c1039.1 SEQ ID NO: 611 | 5' = 60500 (SEQ ID NO: 590) 3' = 61448 (SEQ ID NO: 600) | c1039.1 SEQ ID NO: 611 |

*The signal sequence of the biscFvFc corresponds to amino acids 1-19 of the indicated polypeptide SEQ ID NO. (corresponding to nucleotides 1-57 of the indicated nucleotide SEQ ID NO.)

EXAMPLE 30

Expression of tascFv and biscFv Molecules

Four replicates of a 100 μg aliquot of a tasc or bisc construct is digested with 100 units of Pvu I at 37° C. for three hours, precipitated with IPA, and spun down in a 1.5 mL microfuge tube. The supernatant is decanted off each pellet, 1 mL of 70% ethanol is added and then allowed to incubate for 5 minutes at room temperature. The tubes are spun in a microfuge for 5 minutes at 14,000 RPM and the supernatant decanted off the pellets. Each pellet is resuspended in 500 μl of ZF1 media in a sterile environment and be allowed to incubate at room temperature for 30 minutes. 5E6 to 1E7 5×SA cells per replicate are spun down in each of four tubes and resuspended using the DNA-media solution. Each DNA/cell mixture is placed in a 0.4 cm gap cuvette and electroporated using the following parameters: 950 μF, high capacitance, and 300 V. The contents of the cuvettes are removed, pooled, diluted into a 125 mL shake flask containing 25 mLs of ZF1 media. The flask is placed in an incubator on a shaker at 37° C., 6% $CO_2$, and shaking at 120 RPM. The cell line is then subjected to Methotrexate (MTX) selection and be expanded to higher volumes.

Production of each molecule is accomplished by seeding a selected cell line into a 3 L spinner flask at 4E5 cells/mL in 1500 mL of ZF1 media. The spinner is spun at 85 RPM for 120 hours at 37° C. and 6% $CO_2$, is harvested, filtered through a 1.2 μm and a 0.2 μm filter, and delivered for purification.

EXAMPLE 31

Expression of biAb Molecules

Four replicates of a 100 μg aliquot of biab DNA, comprised of 50 μg of heavy-chain plasmid and 50 μg of light-chain plasmid of a biAb construct pair, is digested with 100 units of PvuI at 37° C. for three hours, precipitated with IPA, and spun down in a 1.5 mL microfuge tube. The supernatant is decanted off each pellet, 1 mL of 70% ethanol is added and then allowed to incubate for 5 minutes at room temperature. The tubes are spun in a microfuge for 5 minutes at 14,000 RPM and the supernatant decanted off the pellets. Each pellet is resuspended in 500 μl of ZF1 media in a sterile environment and is allowed to incubate at room temperature for 30 minutes. $5 \times 10^6$ to $1 \times 10^7$ 5×SA cells per replicate are spun down in each of four tubes and is resuspended using the DNA-media solution. Each DNA/cell mixture is placed in a 0.4 cm gap cuvette and electroporated using the following parameters: 950 μF, high capacitance, and 300 V. The contents of the cuvettes are removed, pooled, diluted into a 125 mL shake flask containing 25 mLs of ZF1 media. The flask is placed in an incubator on a shaker at 37° C., 6% $CO_2$, and shaking at 120 RPM. The cell line is then subjected to methotrexate (MTX) selection and is expanded to higher volumes.

Production of a biab is accomplished by seeding a selected cell line into a 3 L spinner flask at $4 \times 10^5$ cells/mL in 1500 mL of ZF1 media. The spinner is spun for 120 hours at 85 RPM, 37° C., and 6% $CO_2$, is harvested, filtered through a 1.2 μm and a 0.2 μm filter, and delivered for purification.

EXAMPLE 32

Purification of Bispecific Anti-PDGFRβ/VEGF Tandem Single Chain Fv-Fc5 Fusion Proteins from 293 Cells Recombinant bispecific tandem single chain Fv-Fc5 fusion proteins are produced from transfected 293 cells expressing target at >2 mg/L. The 293 transfections are performed using methods known in the art. Conditioned media is harvested, sterile filtered using 0.2 gm filters and adjusted to pH 7.4. The protein is purified from the filtered media using a combination of POROS® A50 Protein A Affinity Chromatography (Applied Biosciences, Foster City, Calif.) and Superdex 200 Size Exclusion Chromatography (GE Healthcare, Piscataway, N.J.) A 4 ml POROS® A50 column (10 mm×50 mm) is pre-eluted with three column volumes (CV) of 25 mM Citrate-Phosphate (1.61 mM Sodium Citrate-23.4 mM Sodium Phosphate,) 250 mM Ammonium Sulfate pH 3 buffer and equilibrated with 20 CV 25 mM Citrate-Phosphate, 250 mM Ammonium Sulfate pH 7.4. Direct loading to the column at 1500 cm/hr at 4° C. captures the fusion proteins in the conditioned media. After loading was complete, the column is washed with 10 CV of 25 mM Citrate-Phosphate, 250 mM Ammonium Sulfate pH 7.4 buffer following which the bound protein was eluted at 1500 cm/hr with a 5 CV gradient from pH 7.4 to pH 3 formed using the Citrate-Phosphate-Ammonium Sulfate buffers. Fractions of 2.0 ml each is collected into tubes containing 200 µl of 2.0 M Tris, pH 8.0 and mixed immediately in order to neutralize the eluted proteins. The fractions are pooled based on A280 and non-reducing SDS-PAGE.

The target-containing pool is concentrated by ultrafiltration using Amicon Ultra-15 30K NWML centrifugal devices (Millipore), to <3% of the volume of an appropriate size Superdex 200 column. The concentrate is injected to the size exclusion column equilibrated in 25 mM Histidine, 125 mM NaCl pH 6.8 and eluted isocratically at 30 cm/hr. The fractions containing purified target are pooled based on A280 and SDS PAGE, filtered through a 0.2 gm filter and frozen as aliquots at −80° C. The concentration of the final purified protein is determined by UV absorption at 280 nm. Analysis of Purified Tandem scFv-Fc5 Fusion Proteins The recombinant proteins are analyzed by SDS-PAGE (4-12% BisTris, Invitrogen, Carlsbad, Calif.) with 0.1% Coomassie 8250 staining for protein and immunoblotting with Anti-IgG-HRP. The purified protein is electrophoresed and transferred to nitrocellulose (0.2 µm; Invitrogen, Carlsbad, Calif.) using the iBlot™ Dry Blotting System (Invitrogen, Carlsbad, Calif.). The filters are then blocked with 10% non-fat dry milk in 50 mM Tris, 150 mM NaCl, 5 mM EDTA, 0.05% Igepal (TBS) for 15 minutes at room temperature. The nitrocellulose is quickly rinsed, and the IgG-HRP antibody (1:10,000) is added. The blots are incubated overnight at 4° C., with gentle shaking. Following the incubation, the blots are washed three times for 10 minutes each in TBS, and then quickly rinsed in $H_2O$. The blots are developed using commercially available chemiluminescent substrate reagents (Pierce SuperSignal), and the signal is captured using ImageQuant instrument and software (GE Healthcare, Piscataway, N.J.).

EXAMPLE 33

In vitro Assays for Testing for Anti-angiogenic Activity of PDGFRβ/VEGF-A Antagonists Endothelial Cell Migration Assay for Measuring Inhibition of Migration of PDGFRβ/VEGFA Antagonist BD Biosciences #354143 Angiogenesis System 24 well insert plates are seeded with sub confluent, low passage HUVEC (human umbilical vein endothelial cells) purchased from Lonza, Rockland Inc., ME. The seeding density is 100,000 cells/insert in a 250 ul volume in DMEM+hepes buffer and 0.1% BSA media. All test and control samples are run in triplicate. Following the addition of cells to the upper insert, the plate wells are filled with a 750 ul volume of test solutions and controls. Positive controls are 10% fetal bovine serum and VEGFA (R&D Systems) at 0.1-50 ng/ml. The negative control is DMEM+hepes buffer and 0.1% BSA. Test samples consist of similar concentrations of VEGFA+PDGFRβ/VEGFA antagonist at varying concentrations. The VEGFA samples (+/−PDGFRβ/VEGFA antagonist) may be made up in low concentrations of FBS. The insert plate is incubated at 37° C., 5% $CO_2$ for 21-23 hours. The migrated HUVEC are measured by labeling them with calcein, AM fluorescent dye (#C3100MP) Molecular Probes). Calcein AM is diluted in warm, 37° C. Hanks Basic Salt Solution at a concentration of 4 ug/ml. The diluted dye is added to each well of a new 24 well plate, 500 µl/well. The inner insert containing the cells is removed from the original plate, and the contents are flicked out into the sink, being careful not to disturb migrated cells adhered to the underside of the insert. The inserts are then placed in the wells containing the calcein dye, and the entire plate is returned to the 37° C., 5% $CO_2$ incubator for 90 minutes. Fluorescent measurements are read from the bottom using the Cytoflour 4000 (Applied BioSystems) at excitation/emission wavelengths of 485/530 nm. The data is expressed as either relative fluorescent units (RFU), or as fold migration over controls.

Inhibition of Endothelial and Pericyte Growth by PDGFRβ/VEGF-S Antagonist in an in vitro Co-culture Sprouting Assay A. Summary To test efficacy of the PDGFRβ/VEGF-A bispecific antagonist, an in vitro co-culture system of endothelial cells and pericytes were established as described (Darland et al, Dev Biol 264 (2003), 275). In this co-culture, HUVECs coated on Cytodex beads are co-cultured with human mesenchymal stem cells (Lonzo) in presence of EGM-2 complete media and D551 fibroblast conditioned media in fibrin gel. Either at start of the experiment or at Day 7 of the experiment, 0.1-50 nM of control antagonist, PDGFRβ antagonist, VEGF-A antagonist or PDGFRβ/VEGF-A antagonist are added to the cultures. Cells are fixed on Day 8 after addition of antagonists using PFA. Cells are then stained by IHC using anti-smooth muscle cell actin (aSMA) or anti-PECAM antibodies to identify pericytes and endothelial cells respectively. In wells with control antagonist treatment, these cells form sprouts of endothelial cells protected by a covering of pericytes. In cells treated with VEGF-A, PDGFRβ, or PDGFRβ/VEGF-A antagonists, numbers of sprouts and length of the sprouts are reduced suggesting that the antagonist shows efficacy in this in vitro coculture model. Efficacy of PDGFRβ or PDGFRβ/VEGF-A antagonists may be further demonstrated by dissociation of pericytes from endothelial cells.

B. Study Design

On Day 1, Cytodex-3 beads are coated with HUVECs and incubated overnight at 37° C., 5% $CO_2$. On Day 2, HUVEC beads (200 beads/well) are embedded in fibrin gel along with human mesenchymal stem cells (hMSC) (40,000 cells/well) in wells of a 24 well plate. A 1:1 mixture of EGM-2 complete media and D551 fibroblast media are added to these cells along with 2 ng/mL of HGF. Medium is replaced every two days till end of the experiment. Antagonists are added to the culture at Day 2 (from start of the co-culture) or at Day 7 (after co-culture formation). Cells are fixed in 4% PFA overnight six days after addition of antagonists. Cells are stained with anti-PECAM or anti-SMA antibodies followed by secondary antibody (fluorescent conjugated). Cells are then viewed by microscope and the numbers and lengths of sprouts counted manually for a representative set of 10 beads/well. The averages for the well are then calculated.

In wells with control antagonist treatment, these cells form sprouts of endothelial cells protected by a covering of pericytes. In cells treated with VEGF-A, PDGFRβ, or PDGFRβ/VEGF-A antagonists, numbers of sprouts and length of the sprouts are reduced suggesting that the antagonist shows efficacy in this in vitro co-culture model. Efficacy of PDGFRβ or PDGFRβ/VEGF-A antagonists may be also be shown by dissociation of pericytes from endothelial cells.

EXAMPLE 34

Chorioallantoic Membrane (CAM) Assay for Evaluating PDGFRβ/VEGF-A Antagonists In Vivo Three-day old fertilized white Leghorn eggs are cracked, and chicken embryos with intact yolks are carefully placed in 20.times.100 mm plastic Petri dishes. After six days of incubation in 3% $CO_2$ at 37° C., a disk of methylcellulose containing at least two PDGF/VEGF molecules (such as VEGF-A and PDGF-BB) and a control monoclonal antibody or a bispecific antibody substance, and/or soluble VEGFR complexes, dried on a nylon mesh (3×3 mm) is implanted on the CAM of individual embryos to determine the influence of bispecific antibody on vascular development and potential uses thereof to inhibit vascular formation. The nylon mesh disks are made by desiccation of 10 microliters of 0.45% methylcellulose (in $H_2O$). After 4-5 days of incubation, embryos and CAMs are examined for the formation of new blood vessels and lymphatic vessels in the field of the implanted disks by a stereoscope. Disks of methylcellulose containing PBS are used as negative controls. Antibodies that recognize both blood and lymphatic vessel cell surface molecules are used to further characterize the vessels. Inhibition of new blood vessel growth in the presence of a bispecific antibody composition relative to a control monoclonal antibody indicates efficacy of the bispecific antibody composition for treatment of angiogenesis associated disorders.

EXAMPLE 35

Corneal Assay for Evaluating PDGFRβ/VEGF-A Antagonists In Vivo

Corneal micropockets are created with a modified von Graefe cataract knife in both eyes of male 5- to 6-week-old C57BL6/J mice or female New Zealand white rabbits. A micropellet (0.35×0.35 mm) of sucrose aluminum sulfate (Bukh Meditec, Copenhagen, Denmark) coated with hydron polymer type NCC (IFN Science, New Brunswick, N.J.) containing various concentrations of two or more PDGF-BB/VEGF-A alone or in combination with: i) factors known to modulate vessel growth (e.g., 80 ng of FGF-2); ii) monoclonal antibody specific for one of the growth factors; or iii) a bispecific antibody composition. The pellet is positioned 0.6-0.8 mm from the limbus. After implantation, erythromycin/ophthalmic ointment is applied to the eyes. Eyes are examined by a slit-lamp biomicroscope over a course of 3-12 days. Vessel length and clock-hours of circumferential neovascularization and lymphangiogenesis are measured. Furthermore, eyes are cut into sections and are immunostained for blood vessel and/or lymphatic markers LYVE-1 (Prevo et al., *J. Biol. Chem.* 276: 19420-19430, 2001), podoplanin (Breiteneder-Geleff et al., *Am. J. Pathol.* 154: 385-94, 1999) to further characterize affected vessels. Inhibition of vessel growth in the presence of a bispecific antibody composition relative to a control antibody indicates efficacy of the bispecific antibody composition for treatment of angiogenesis associated disorders.

EXAMPLE 36

A673 Rhabdomyosarcoma Model for Evaluating Efficacy of PDGFRβ/VEGF-A Antagonists Against Tumor Growth Summary To test if the PDGFRβ/VEGF-A bispecific antagonist has activity on tumor growth in mice, groups of mice are injected s.c with the A673 rhabdomyosarcoma tumor on Day 0. Once tumors grew to 150-200 $mm^3$, groups of mice (n=10/gp) mice are then injected with 1 mg/Kg to 30 mg/Kg control reagent, VEGF-A antagonist, PDGFRβ antagonist or PDGFRβ/VEGF-A antagonist 1×-3×/week for 3 weeks. Tumor volume is monitored 3×/week for 5 weeks. Significantly smaller tumors in mice injected with a VEGF-A antagonist, PDGFRβ antagonist, or PDGFRβ/VEGF-A antagonist, as compared to mice injected with control reagent, indicates efficacy of the antagonist for inhibition of tumor growth. Efficacy of a PDGFRβ/VEGF-A antagonist over individual treatments with either VEGF-A antagonist or PDGFRβ antagonist alone can also be evaluated.

Study Design

Eight to ten-week old female C.B-17 SCID mice (Charles River Laboratories) are injected s.c. on the right flank with $2×10^6$ A673 cells on Day O, Starting with a tumor size of 150-200 $mm^3$, groups of mice (n=10/group) are injected i.p. with 1 mg/Kg to 30 mg/Kg control reagent, VEGF-A antagonist, PDGFRβ antagonist or PDGFRβ/VEGF-A antagonist 1×-3×/week for 3 weeks. Tumor growth is monitored 3×/week for 5 weeks using caliper measurements. Tumor volume is calculated using the formula $½*(B)^2*L$ ($mm^3$).

EXAMPLE 37

BxPC3 Pancreatic Carcinoma Model for Evaluating Efficacy of PDGFRβ/VEGF-A Antagonists Against Tumor Growth Summary To test if the PDGFRβ/VEGF-A bispecific antagonist has activity on tumor growth in mice, groups of mice are injected s.c with the BxPC3 pancreatic tumor on Day 0. Once tumors grow to 150-200 $mm^3$, groups of mice (n=10/gp) mice are then injected with 1 mg/Kg to 30 mg/Kg control reagent, VEGF-A antagonist, PDGFRβ antagonist, or PDGFRβ/VEGF-A antagonist 1×-3×/week for 3 weeks. Tumor volume is monitored 3×/week for 5 weeks. Significantly smaller tumors in mice injected with a VEGF-A antagonist, PDGFRβ antagonist, or PDGFRβ/VEGF-A antagonist, as compared to mice injected with control reagent, indicates efficacy of the antagonist for inhibition of tumor growth. Efficacy of a PDGFRβ/VEGF-A antagonist over individual treatments with either VEGF-A antagonist or PDGFRβ antagonist alone can also be evaluated.

Study Design

Eight to ten-week old female C.B-17 SCID mice (Charles River Laboratories) are injected s.c. on the right flank with $2\times10^6$ BxPC-3 cells on Day O, Starting with a tumor size of 150-200 mm³, groups of mice (n=10/group) are injected i.p. with 1 mg/Kg to 30 mg/Kg control reagent, VEGF-A antagonist, PDGFRβ antagonist or PDGFRβ/VEGF-A antagonist 1×-3×/week for 3 weeks. Tumor growth is monitored 3×/week for 5 weeks using caliper measurements. Tumor volume is calculated using the formula ½*(B)²*L (mm³).

EXAMPLE 38

Corneal Neovascularization (Corneal NT) Model of Ocular Disease for Evaluating Efficacy of PDGFRβ/VEGF-A Antagonists Corneal Neovascularization is a widely used animal model that allows clear visualization of abnormal vascular growth in the eye. The vessels that grow into the normally avascular cornea, can become well established, making this an attractive model to study vessel regression. In this example, effectiveness of PDGFRβ/VEGF-A antagonist is demonstrated using the corneal neovascularization model. To induce experimental corneal NV, male C57BL/6 mice (18-20 g; Charles River, Wilmington, Mass.) are anesthetized with intramuscular ketamine hydrochloride (25 mg/kg) and xylazine (10 mg/kg). NaOH (2 µl of 0.2 mM) are applied topically. The corneal and limbal epithelia are removed by applying a rotary motion parallel to the limbus using #21 blade (Feather, Osaka, Japan). After 7 days or 10 days (regression model), mice are treated with intra-peritoneal injections of 1-25 mg/kg of control reagent, VEGF-A antagonist, PDGFRβ antagonist, or PDGFRβ/VEGF-A bispecific antagonist. At day 14 or day 20 (regression model) following corneal NV induction, mice receive 20 µg/g of fluorescein-isothiocyanate coupled concanavalin A lectin (Vector Laboratories, Burlingame, Calif.) intravenously whilst deeply anesthetized with xylazine hydrochloride and ketamine hydrochloride. Thirty minutes later, mice eyes are enucleated, and the corneas flat-mounted. Corneal NV is visualized using fluorescence microscopy and quantified using Openlab software. The percent of cornea covered by vessels is calculated as a percentage of total corneal area. The results demonstrate the efficacy of the PDGFRβ/VEGF-A antagonists relative to control reagent, or over individual treatments with the PDGFRβ or VEGF-A antagonists alone.

EXAMPLE 39

Corneal Neovascularization (Corneal NT) Model of Ocular Disease for Evaluating Efficacy of PDGFRβ/VEGF-A Antagonists Against Age-related Macular Degeneration (AMD)

Experimental CNV is often used as a model for Age-related macular degeneration (AMD). In this model, vessels of the choroid grow through breaks in Bruch's membrane and into the retina, similar to what is observed in AMD patients. To induce experimental CNV, male C57BL/6 mice (18-20 g; Charles River, Wilmington, Mass.) are anesthetized with intramuscular ketamine hydrochloride (25 mg/kg) and xylazine (10 mg/kg) and the pupils are dilated with 1% tropicamide. Four burns are generated using diode laser photocoagulation (75 µm spot size, 0.1-second duration, 90 mW, Oculight SL laser, IRIDEX, Mountain View, Calif.) and a hand-held cover slide as a contact lens. Burns localized to the 3, 6, 9, and 12 o'clock positions of the posterior pole of the retina. Production of a bubble at the time of laser, which indicates rupture of Bruch's membrane, is an important factor in obtaining choroidal neovascularization, so only mice in which a bubble was produced for all four burns are included in the study. After 7 days or 14 days (regression model), mice are treated daily with an intraperitoneal injection of 1-25 mg/kg of control reagent, VEGF-A antagonist, PDGFRβ antagonist, or PDGFRβ/VEGF-A bispecific antagonist twice a day. After 7 days or 14 days (regression model) of treatment, the area of choroidal NV lesions is measured in flat-mounted choroid stained with PECAM. Flat-mounts are examined by fluorescence microscopy and quantified using Openlab software. Decrease in CNV area in the eyes treated with PDGFRβ/VEGF-A antagonist, relative to control reagent, indicates that the bispecific antagonist is a potent inhibitor of neovascularization. Decrease in CNV area in the eyes treated with PDGFRβ/VEGF-A antagonist, relative to either VEGF-A antagonist or PDGFRβ antagonist alone, indicates efficacy of the PDGFRβ/VEGF-A antagonist over the individual treatments.

EXAMPLE 40

Characterization of Anti-Hu-PDGF-Receptor-β Antagonists

Epitope binning experiments were performed to determine which PDGFR-β antagonists (scFv, Fab, huIgG, msIgG) are capable of binding simultaneously to human PDGFR-β. PDGFR-β antagonists that compete for the same, or an overlapping, binding site (epitope) on the antigen are not able to bind simultaneously and are functionally grouped into a single family or "epitope bin." PDGFR-β antagonists that do not compete for the same binding site on the antigen are able to bind simultaneously and are grouped into separate families or epitope bins. Experiments were performed using a Biacore 3000™ instrument. Biacore is only one of a variety of assay formats that are routinely used to assign panels of antibody fragments and monoclonal antibodies to epitope bins. Many references (e.g., *The Epitope Mapping Protocols, Methods in Molecular Biology*, Volume 6,6 Glenn E. Morris ed.) describe alternative methods that can be used to "bin" the antibody fragments and which would be expected to provide comparable data regarding the binding characteristics of the PDGFR-β antagonists to PDGFR-β Fc5. Epitope binning experiments were performed with PDGFRβ-Fc5 (SEQ ID NO:486).

Materials and Methods

Epitope binning studies were performed on a Biacore3000® system (GE Healthcare, Piscataway, N.J.). Methods were programmed using Biacore3000® Control Software v. 3.2. Polyclonal goat anti-human IgG Fc-gamma antibody (Jackson ImmunoResearch Laboratories, West Grove, Pa.) was covalently immobilized to a Biacore® CM5 sensor chip using amine coupling chemistry (EDC:NHS) to a density of 8,000RU. After the immobilization procedure, active sites on the flow cell were blocked with ethanolamine. The non-specifically bound protein was removed by washing with 50 mM NaOH. PDGFRβ-Fc5 antigen and PDGFR-β antagonists were diluted to 5 µg/ml.

PDGFR-β Fc5 was captured on the anti-human Fc surface at approximately 250RU. This was followed with blocking of the unoccupied Fc binding sites on the chip using whole hu-IgG (Jackson ImmunoResearch Laboratories, West Grove, Pa.). A primary PDGFR-β antagonist injected for 120 seconds at 20 µl/min and allowed to specifically bind to the captured PDGFR-β-Fc5 at the saturation level. The Biacore™ instrument measures the mass of protein bound to the sensor chip and the binding of both PDGFRβ-Fc5 and the primary binning candidate can be verified for each cycle. Following the binding of the primary PDGFR-β antagonist, a secondary PDGFR-β antagonist was injected and allowed to bind to the PDGFR-β Fc5 that is captured on the anti-human Fc surface.

All binding experiments were performed at 25° C. in a buffer of 10 mM HEPES, 500 mM NaCl, 3 mM EDTA, 0.05% surfactant P20, 0.01 mg/mL bovine serum albumin, pH 7.4. Buffer injections were also performed to allow for subtraction of instrument noise and drift. Between cycles, the flow cell was washed with 10 mM Glycine, pH 1.75 to remove bound PDGFRβ Fc5. Data was compiled using Biacore 3000™ Evaluation software.

The experimental results were interpreted as follows. If the secondary PDGFR-β antagonist was not capable of binding to PDGFR-β-Fc5 antigen simultaneously with the primary antagonist, it was functionally grouped into a single family or epitope bin. However, if the secondary PDGFR-β antagonist was capable of binding the antigen simultaneously with the primary antagonist by showing an increase in mass on the surface of the chip it was grouped into a separate family or epitope bin. Each PDGFR-β antagonist was tested against itself as a negative control to establish the level of the background (no-binding) signal.

Results

Purified PDGFR-β antagonists were characterized and assigned into epitope bins (see Table 25). The signal (RU, response units) reported by the Biacore is directly correlated to the mass on the sensor chip surface. Once the level of background signal (RU) associated with the negative controls was established (the same PDGFR-β antagonists used as both the primary and secondary antagonists), the binning results were reported as either positive or negative binding. Positive binding indicates that two different PDGFR-β antagonists are capable of binding the antigen simultaneously. Negative binding indicates that two different PDGFR-β antagonists are not capable of binding the antigen simultaneously.

The differential between positive and negative response values in this experiment was significant and allowed for an unambiguous assignment of the 8 purified PDGFR-β antagonists into two distinct families or epitope bins. The first epitope bin is represented by PDGFR-β antagonists produced by clones c941.1, c1035, c951.1, c975.1 (all scFv), c597.1 (Fab), c600.1 (hIgG), and murine anti-human PDGFR-β monoclonal antibody 163.3.1.1.1. The second bin is represented by murine anti-human PDGFR-β monoclonal antibody 162.6.2.6.2. In addition, PDGFR-β antagonist c1035.1 was found to overlap between bin #1 and bin #2.

TABLE 25

Epitope Bin Assignments for Neutralizing PDGFR-β antagonists

| Epitope Bin # | PDGFR-β antagonists |
| --- | --- |
| Bin#1: | c941.1, c597.1, c951.1, c975.1, c600, mAb 163.3111 |
| Bin#2: | mAb 162.6262 |
| Bin#1/2: | c1035.1 |

EXAMPLE 41

Epitope Binning of VEGF-A Antagonists

Epitope binning experiments were performed to determine which VEGF-A antagonists are capable of binding simultaneously to human VEGF-A. VEGF-A antagonists that compete for the same, or an overlapping, binding site (epitope) on the antigen are not able to bind simultaneously and are functionally grouped into a single family or "epitope bin." VEGF-A antagonists that do not compete for the same binding site on the antigen are able to bind simultaneously and are grouped into separate families or epitope bins. Experiments were performed using a Biacore T100™ instrument. Biacore is only one of a variety of assay formats that are routinely used to assign panels of antibody fragments and monoclonal antibodies to epitope bins. Many references (e.g., The Epitope Mapping Protocols, Methods in Molecular Biology, Volume 6,6 Glenn E. Morris ed.) describe alternative methods that can be used to "bin" the antibody fragments and which would be expected to provide comparable data regarding the binding characteristics of the VEGF-A antagonists to human VEGF-A. Epitope binning experiments were performed with soluble, native human VEGFA as the antigen.

Materials and Methods

Two separate epitope binning experiments were performed on a BIACORE T100™ system (GE Healthcare, Piscataway, N.J.). In both experiments, the primary VEGF-A antagonists were covalently immobilized on a CM5 sensor chip using amine coupling chemistry (EDC: NHS) to a density of approximately 800-1000 RU. After the immobilization procedure, remaining active sites on the flow cell were blocked with ethanolamine. Non-specifically bound protein was removed by washing with 50 mM NaOH. The reference cell was also activated and then blocked with ethanolamine without the VEGF-A antagonist.

In the first set of experiments, secondary VEGF-A antagonists and the VEGF-A antigen were diluted to 100 nM. VEGF-A antigen was injected and allowed to specifically bind to a VEGF-A antagonist immobilized on the sensor chip. VEGF-A is a dimer, therefore there are two potential binding sites for every VEGF-A antagonist. To ensure all binding sites were occupied, the primary VEGF-A antagonist that was previously immobilized was injected over VEGF-A. Following this step, secondary VEGF-A antagonist was injected to observe simultaneous binding to VEGF-A.

In a second set of binning experiments, primary VEGF-A antagonists were again covalently immobilized to separate flow cells of a BIACORE CM5 sensor chip. In this experiment however, 10 nM VEGF-A antigen was premixed with 1 mM of the secondary VEGF-A antagonists, then injected over the immobilized primary VEGF-A antagonist in a competition format.

All binding experiments were performed at 25° C. in a buffer of 10 mM HEPES, 150 mM NaCl, 3 mM EDTA 0.05% Surfactant P20, 1 mg/ml bovine serum albumin, pH 7.4. Buffer injections were also performed to allow for subtraction of instrument noise and drift. Between cycles, capture surface was regenerated after each injection cycle via 60 second injection of 10 mM Glycine, pH 1.5 at 50 ul/min. This removed the bound VEGF-A from the surface. Data was compiled using Biacore T100™ Evaluation software (version 1.1.1).

Both sets of experimental results were interpreted as follows. If the secondary VEGF-A antagonist was not capable of binding to VEGF-A antigen simultaneously with the primary antagonist, it was functionally grouped into a single family or epitope bin. However, if the secondary VEGF-A antagonist was capable of binding the antigen simultaneously with the primary antagonist by showing an increase in mass on the surface of the chip it was grouped into a separate family or epitope bin. Each VEGF-A antagonist was tested against itself as a negative control to establish the level of the background (no-binding) signal.

Results

The purified VEGF-A antagonists were assigned into epitope bins using the binding data from the two set of experiments described above. The signal (RU, response units) reported by the BIACORE™ is directly correlated to the mass on the sensor chip surface. Once the level of background signal (RU) associated with the negative controls was established (the same VEGF-A antagonist used as both the primary and secondary antagonists), the binning results were reported as either positive or negative binding. Positive binding indicates that two different VEGF-A antagonists are capable of binding the antigen simultaneously. Negative binding indicates that two different VEGF-A antagonists are not capable of binding the antigen simultaneously.

The differential between positive and negative response values in these experiments was used to assign the VEGF-A antagonists into three families or epitope bins (see Table 26). The first epitope bin is represented by VEGF-A antagonist produced by clone c636. A second epitope bin is represented by VEGF-A antagonists c868, c1039, and c1081. Of note, when c636 was the first to interact with VEGF-A, both c868 and c1039 showed simultaneous binding. When either c868 or c1039 interacted with VEGF-A first, c636 did not show any binding, therefore c868 and c1039 are overlapping the c636 epitope. In addition, VEGF-A antagonist c870 overlapped bin #1 and bin #2. A third epitope bin is represented by VEGF-A antagonist c820 and the positive control VEGF-A antibody (mouse anti VEGF-A monoclonal antibody, R&D Systems). Both of these VEGF-A antagonists showed simultaneous binding in the presence of all the other VEGF-A antagonists. All of the antagonists tested in the binning experiments were shown to neutralize VEGF-A mitogenic activity to some degree.

TABLE 26

Epitope Bin Assignments for Neutralizing VEGF-A antagonists

| Epitope Bin # | VEGF-A antagonists |
|---|---|
| Bin#1: | c636 |
| Bin#2: | c868, c1039, c1081 |
| Bin#1/2: | c870 |
| Bin#3: | c820, mouse mAb |

EXAMPLE 42

Measurement of Binding Affinities of Human VEGF-A Antagonists to VEGF-A Via Surface Plasmon Resonance (Biacore)

Monovalent human VEGF-A antagonists produced by clones c868, c870 and c1039 were evaluated for their binding affinities to human VEGF-A using surface plasmon resonance.

Affinity Determination

Kinetic rate constants and equilibrium dissociation constants were measured for the interaction of VEGF-A antagonists with the VEGF-A via surface plasmon resonance. The association rate constant ($k_a$ ($M^{-1}s^{-1}$)) is a value that reflects the rate of the antigen-antagonist complex formation. The dissociation rate constant ($k_d$ ($s^{-1}$)) is a value that reflects the stability of this complex. By dividing the association rate constant by the dissociation rate constant ($k_a/k_d$) the equilibrium association constant ($K_A$ ($M^{-1}$)) is obtained. By dividing the dissociation rate constant by the association rate constant ($k_d/k_a$) the equilibrium dissociation constant ($K_D$ (M)) is obtained. This value describes the binding affinity of the interaction. Interactions with the same $K_D$ can have widely variable association and dissociation rate constants. Consequently, measuring both the $k_a$ and $k_d$ helps to more uniquely describe the affinity of the interaction.

Materials and Methods

A series of experiments were completed to measure the binding affinities of purified VEGF-A antagonists produced by clones c868, c870 and c1039. Binding kinetics and affinity studies were performed on a Biacore T100™ system (GE Healthcare, Piscataway, N.J.). Methods were programmed using Biacore T100™ Control Software, v 1.1.1. The VEGF-A antagonists were produced with $His_6$/Myc epitope tags. Affinity analyses was performed by capturing VEGF-A antagonists using anti-$His_6$/Myc antibodies immobilized on a CM5 chip. Anti-$His_6$ and anti-Myc antibodies were mixed in 1:1 molar ratio and covalently immobilized to a CM5 sensor chip using amine coupling chemistry to a density of approximately 7500 RU. 10 nM of VEGF-A antagonists were injected on separate flow cells at 10 ul/min for 1 minute, followed with a 1 minute stabilization period. Serial 1:3 dilutions of VEGF-A from 33.3 nM-0.14 nM were injected over this surface and allowed to specifically bind to VEGF-A antagonist captured on the sensor chip. Duplicate injections of each VEGF-A concentration were performed with an association time of 5 minutes and dissociation time of 10 minutes. Kinetic binding studies were performed with a flow rate of 30 µL/min. All binding experiments were performed at 25° C. in a buffer of 10 mM HEPES, 500 mM NaCl, 3 mM EDTA 0.05% Surfactant P20, 0.1 mg/ml bovine serum albumin, pH 7.4. Between cycles, the flow cell was washed with 50 mM $H_3PO_4$ to regenerate the surface. This wash step removed the captured VEGF-A antagonist from the immobilized antibody surface, and allowed for the subsequent binding of the next sample.

Data was compiled using Biacore T100™ Evaluation software (version 1.1.1). Data was processed by subtracting reference flow cell and blank injections. Baseline stability was assessed to ensure that the regeneration step provided a consistent binding surface throughout the sequence of injections. Duplicate injection curves were checked for reproducibility. Since VEGF-A antigen forms dimers, the resulting binding curves were globally fitted to the bivalent analyte interaction model.

Results

Three VEGFA antagonists were characterized for their binding affinity for VEGF-A (results summarized in Table 27). Association rate constants ($k_a$ ($M^{-1}s^{-1}$)) and dissociation rate constants ($k_d$ ($s^{-1}$)) were measured for these human VEGF-A antagonists. $K_D$ and $K_A$ were calculated from the $k_a$ and $k_d$ values. The data fit well to the bivalent analyte model. This model measures two values for both $k_a$ ($k_{a1}$ and $k_{a2}$) and for $k_d$ ($k_{d1}$ and $K_{d2}$). The first set of values ($k_{a1}$ and $k_{d1}$) describes the monovalent kinetics of the interaction which are reported in Table 24. The affinity reported for these samples was derived from these values, and is designated $K_{D1}$. $K_D$ and $K_A$ were calculated from the $k_a$ and $k_d$ values. All three VEGF-A antagonists showed similar affinity to VEGF-A antigen ($K_D$=0.7-1.0E-9M) and these results were consistent in two independent run.

TABLE 27

Characterization of VEGF-A Antagonist Binding Affinity for VEGF-A

| ID # | $k_a$ (M$^{-1}$s$^{-1}$) | $k_d$ (s$^{-1}$) | $K_D$ (M) | $K_A$ (M$^{-1}$) |
|---|---|---|---|---|
| c868 | 5.E+5 | 6.E−4 | 1.E−9 | 8.E+8 |
| c870 | 2.E+5 | 2.E−4 | 1.E−9 | 1.E+9 |
| c1039 | 3.E+5 | 2.E−4 | 6.E−10 | 2.E+9 |

EXAMPLE 43

Measurement of Binding Affinities of Human VEGFA/PDGFRβ Antagonist to the VEGFA Via Surface Plasmon Resonance (Biacore)

Two human VEGF-A/PDGFR-β antagonists were evaluated for binding affinities to human VEGF-A using surface plasmon resonance. Both of these VEGF-A/PDGFR-β antagonists consist of five domains: two VEGF-A binding domains (two c868 or two c1039) and two PDGFR-β binding domains (two c597) that are tethered by a human Fc tag.

Affinity Determination

Kinetic rate constants, equilibrium association and dissociation constants were measured for the interaction of the VEGF-A/PDGFRβ antagonists A2099F (consisting of two c1039 and two c597 domains) and A2100F (consisting of two c868 and two c597 domains) with the VEGF-A antigen via surface plasmon resonance.

Materials and Methods

A series of experiments was completed to measure the binding affinity of purified VEGF-A/PDGFR-β antagonists generated against VEGF-A (R & D Systems) and PDGFR- (ZymoGenetics) antigens. Binding kinetics and affinity studies were performed on Biacore T100™ system (GE Healthcare, Piscataway, N.J.). Methods were programmed using Biacore T100™ Control Software, v 1.1.1. Human VEGF-A antigen was covalently immobilized onto a flow cell of the CM5 sensor chip using amine coupling chemistry (EDC: NHS) to a density of approximately 160 RU. Serial 1:3 dilutions of the VEGF-A/PDGFR-β antagonists from 11.1 nM-0.14 nM were injected over the surface and allowed to specifically bind to the VEGF-A immobilized on the sensor chip. Duplicate injections of VEGF-A/PDGFR-β antagonists were performed with an association time of 10 minutes and dissociation time of 15 minutes. Kinetic binding studies were performed with a flow rate of 30 µL/min. All binding experiments were performed at 25° C. in a buffer of 10 mM HEPES, 150 mM NaCl, 3 mM EDTA 0.05% Surfactant P20, 0.1 mg/ml bovine serum albumin, pH 7.4. In order to regenerate the surface, flow cells were washed with 10 mM Glycine, pH 1.5 in between each cycle.

Data was compiled using Biacore T100™ Evaluation software (version 1.1.1). Data was processed by subtracting reference flow cell and blank injections and baseline stability was assessed to ensure that the regeneration step provided a consistent binding surface throughout the sequence of injections. Duplicate injection curves were checked for reproducibility. Because both VEGF-A antigen and the VEGF-A/PDGFR-β antagonists are bivalent molecules, the resulting binding curves for the VEGF-A/PDGFR-β antagonists binding to VEGF-A antigen were globally fitted to the bivalent analyte model.

Results

Purified VEGF-A/PDGFR-β antagonists were characterized for their binding affinity for the VEGF-A antigen (results summarized in Table 28). Association rate constants ($k_a$ (m$^{-1}$S$^{-1}$)) and dissociation rate constants ($k_d$ (s$^{-1}$)) were measured for binding unit. $K_D$ and $K_A$ for each interaction were calculated from the $k_a$ and $k_d$ values. Binding affinity of the VEGF-A/PDGFR-β antagonists to VEGF-A antigen were determined by immobilizing the VEGF-A antigen and injecting the VEGF-A/PDGFR-β antagonists over this surface. The resulting data sets fit well to the bivalent interaction analyte model. This model measures two values for both $k_a$ ($k_{a1}$ and $k_{a2}$) and for $k_d$ ($k_{d1}$ and $k_{d2}$). The first set of values ($k_{a1}$ and $k_{d1}$) describes the monovalent kinetics of the interaction which are reported in Table 28. The affinity reported for these samples was derived from these values, and is designated $K_{D1}$. $K_D$ and $K_A$ were calculated from the $k_a$ and $k_d$ values. Under these assay conditions, the binding affinity of VEGF-A/PDGFR-β antagonist A2100F to VEGF-A was 5.E-9M.

TABLE 28

Characterization of VEGF-A/PDGFR-β Antagonist Binding Affinity for VEGF-A

| ID # | $k_a$ (M$^{-1}$s$^{-1}$) | $k_d$ (s$^{-1}$) | $K_D$ (M) | $K_A$ (M$^{-1}$) |
|---|---|---|---|---|
| c597/c1039 | 7.E+5 | 4.E−4 | 5.E−10 | 2.E+9 |
| c597/c868 | 7.E+4 | 4.E−4 | 5.E−9 | 2.E+8 |

EXAMPLE 44

Inhibition of Human Hepatocellular Carcinoma Cell Growth In Vivo Using Anti-PDGFRβ/Anti-VEGF-A Bispecific Antibody To evaluate anti-tumor activity of an anti-PDGFRβ/anti-VEGF-A bispecific antibody against human hepatocellular carcinoma cells in vivo, groups of BALB/c nude mice are injected with either HuH7 or C3A hepatocellular carcinoma cells on Day 0. Groups (n=10/group) of tumor bearing mice receive 5 ug-75 ug of anti-PDGFRβ/anti-VEGF-A bispecific antibody by i.p. or peritumoral injection every other day (EOD) from Days 5-33. Tumor volume is monitored 3x/week for 6 weeks. Inhibition of tumor growth by anti-PDGFRβ/anti-VEGF-A bispecific antibody indicates that the respective protein has inhibitory effects on human hepatocellular carcinoma in vivo.

Study design: Eight-week old female BALB/c nude mice (Charles River Laboratories) are injected s.c. on the right flank with 6×10$^6$ HuH7 or C3A cells on Day 0. Groups of mice (n=10/group) are injected i.p. or peritumorally with 5 µg-75 µg of an anti-PDGFRβ/anti-VEGF-A bispecific antibody from days 5-33. Injections are given in a total volume of 200 µl. Tumor growth is monitored 3x/week for 6 weeks using caliper measurements. Tumor volume was calculated using the formula ½*(B)$^2$*L (mm$^3$).

EXAMPLE 45

Inhibition of Human Prostate Carcinoma Cell Growth In Vivo Using Anti-PDGFRβ/Anti-VEGF-A Bispecific Antibody To evaluate anti-tumor activity of an anti-PDGFRβ/anti-VEGF-A bispecific antibody against human prostate carcinoma cells in vivo, groups of BALB/c nude mice are injected with either PC-3 or DU-145 prostate carcinoma cells on Day 0. Groups (n=10/group) of tumor bearing mice receive 5 µg-75 µg of anti-PDGFRβ/anti-VEGF-A bispecific antibody by i.p. or peritumoral injection every other day (EOD) from Days 5-33. Tumor volume is monitored 3×/week for 6 weeks. Inhibition of tumor growth (volume or weight) by an anti-PDGFRβ/anti-VEGF-A bispecific antibody indicates that the respective protein has inhibitory effects on human prostate carcinoma in vivo.

Study design: Eight-week old female BALB/c nude mice (Charles River Laboratories) are injected s.c. on the right flank or orthotopically in the prostate lobe with $10 \times 10^6$ PC-3 or $6 \times 10^6$ DU-145 cells on Day 0. Groups of mice (n=10/group) are injected i.p. or peritumorally (s.c model only) with 5 µg-75 mg of anti-PDGFRβ/anti-VEGF-A bispecific antibody from days 5-33. Injections are given in a total volume of 200 µl. For s.c tumors, tumor growth is monitored 3×/week for 6 weeks using caliper measurements. Tumor volume is calculated using the formula $½*(B)^2*L$ (mm$^3$). For orthotopic tumors, mice are terminated at the end of the study and tumor weighed to enable tumor load assessment.

EXAMPLE 46

Murine Prostate Cancer Model for Evaluating Efficacy of Anti-PDGFRβ/Anti-VEGF-A Bispecific Antibody The effects of an anti-PDGFRβ/anti-VEGF-A bispecific antibody on tumor response are evaluated in murine prostate cancer model, using a model similar to that described in Kwon et al., *Proc. Natl. Acad. Sci. USA* 96:15074-15079, 1999. In this model, there is a metastatic outgrowth of transgenic adenocarcinoma of mouse prostate (TRAMP) derived prostate cancer cell line TRAMP-C2, which are implanted in C57BL/6 mice. Metastatic relapse is reliable, occurring primarily in the draining lymph nodes in close proximity to the primary tumor.

Briefly, the C2 cell line used is an early passage line derived from the TRAMP mouse that spontaneously develops autochthonous tumors attributable to prostate-restricted SV40 antigen expression. The cells are cultured and injected subcutaneously into the C57BL/6 mice at $2.5-5 \times 10^6$ cells/0.1 ml media. Mice are treated with anti-PDGFRβ/anti-VEGF-A bispecific antibody beginning 3-14 days following tumor implantation, or when tumor engraftment and growth rate is established. Treatment levels of 0.5-5 mg/kg will be administered on a daily basis for 5-14 days, and may be continued thereafter if no evidence of neutralizing antibody formation is seen. The tumors are excised after sacrificing the animals and analyzed for volume and using histochemistry and immunohistochemistry.

EXAMPLE 47

Inhibition of Human Colon Carcinoma Cells In Vivo Using Anti-PDGFRβ/Anti-VEGF-A Bispecific Antibody To evaluate anti-tumor activity of an anti-PDGFRβ/anti-VEGF-A bispecific antibody against human colon carcinoma cells in vivo, groups of BALB/c nude mice are injected with either DLD-1 or HCT-116 colon carcinoma cells on Day 0. Groups (n=10/group) of tumor bearing mice receive 5 µg-75 ng human anti-PDGFRβ/anti-VEGF-A bispecific antibody by i.p. or peritumoral injection every other day (EOD) from Days 5-33. Tumor volume is monitored 3×/week for 6 weeks. Inhibition of tumor growth (volume or weight) by anti-PDGFRβ/anti-VEGF-A bispecific antibody suggests that the respective protein has inhibitory effects on human colon carcinoma in vivo.

Study design: Eight-week old female BALB/c nude mice (Charles River Laboratories) are injected s.c. on the right flank or orthotopically in the colonic wall with $6 \times 10^6$ DLD-1 or HCT-116 cells on Day 0. Groups of mice (n=10/group) are injected i.p. or peritumorally (for s.c model only) with 5 µg-75 ng human an anti-PDGFRβ/anti-VEGF-A bispecific antibody from days 5-33. Injections are given in a total volume of 200 µl. For s.c tumors, tumor growth is monitored 3×/week for 6 weeks using caliper measurements. Tumor volume is calculated using the formula $½*(B)^2*L$ (mm$^3$). For orthotopic tumors, mice are terminated at the end of the study and tumor weighed to enable tumor load assessment.

EXAMPLE 48

Mouse Colorectal Tumor Model for Evaluating Efficacy of Anti-PDGFRβ/Anti-VEGF-A Bispecific Antibody The effects of an anti-PDGFRβ/anti-VEGF-A bispecific antibody in a colorectal mouse model are tested as described in Yao et al., *Cancer Res.* 63:586-592, 2003. In this model, MC-26 mouse colon tumor cells are implanted into the splenic subcapsule of BALB/c mice. After 14 days, the treated mice are administered anti-PDGFRβ/anti-VEGF-A bispecific antibody. Mice are treated with anti-PDGFRβ/anti-VEGF-A bispecific antibody beginning 3-14 days following tumor implantation, or when tumor engraftment and growth rate is established. Treatment levels of 0.5-5 mg/kg are administered on a daily basis for 5-14 days, and may be continued thereafter if no evidence of neutralizing antibody formation is seen.

The efficacy of an anti-PDGFRβ/anti-VEGF-A bispecific antibody in prolonging survival or promoting a tumor response is evaluated using standard techniques such as described herein.

EXAMPLE 49

Inhibition of Human Pancreatic Carcinoma Cells In Vivo Using Anti-PDGFRβ/Anti-VEGF-A Bispecific Antibody To evaluate anti-tumor activity of an anti-PDGFRβ/anti-VEGF-A bispecific antibody against human pancreatic carcinoma cells in vivo, groups of BALB/c nude mice are injected with either BxPC-3 or HPAF-II pancreatic carcinoma cells on Day 0. Groups (n=10/group) of tumor bearing mice receive 5 µg-75 µg of anti-PDGFRβ/anti-VEGF-A bispecific antibody by i.p. or peritumoral injection every other day (EOD) from Days 5-33. Tumor volume is monitored 3×/week for 6 weeks. Inhibition of tumor growth (volume or weight) by anti-PDGFRβ/anti-VEGF-A bispecific antibody suggests that the respective protein has inhibitory effects on human pancreatic carcinoma in vivo.

Study design: Eight-week old female BALB/c nude mice (Charles River Laboratories) are injected s.c. on the right flank or orthotopically in the pancreatic lobe with $6 \times 10^6$ BxPC-3 or HCT-116 cells on Day 0. Groups of mice (n=10/group) are injected i.p. or peritumorally (for s.c model only) with 5 µg-75 µg of anti-PDGFRβ/anti-VEGF-A bispecific antibody from days 5-33. Injections are given in a total volume of 200 µl. For s.c tumors, tumor growth is monitored 3×/week for 6 weeks using caliper measurements. Tumor volume was calculated using the formula $\frac{1}{2}*(B)^2*L$ (mm$^3$). For orthotopic tumors, mice are terminated at the end of the study and tumor weighed to enable tumor load assessment.

EXAMPLE 50

Mouse Pancreatic Cancer Model for Evaluating Efficacy of Anti-PDGFRβ/Anti-VEGF-A Bispecific Antibody The efficacy of an anti-PDGFRβ/anti-VEGF-A bispecific antibody in a mouse pancreatic cancer model is evaluated using the protocol developed by Mukherjee et al., *J. Immunol.* 165:3451-3460, 2000. Briefly, MUC1 transgenic (MUC1.Tg) mice are bred with oncogene-expressing mice that spontaneously develop tumors of the pancreas (ET mice) designated as MET. MUC1.Tg mice. ET mice express the first 127 aa of SV40 large T Ag under the control of the rat elastase promoter. Fifty percent of the animals develop life-threatening pancreatic tumors by about 21 wk of age. Cells are routinely tested by flow cytometry for the presence of MUC1. All mice are on the C57BL/6 background. Animals are sacrificed and characterized at 3-wk intervals from 3 to 24 wk. Mice are carefully observed for signs of ill-health, including lethargy, abdominal distention, failure to eat or drink, marked weight loss, pale feces, and hunched posture.

The entire pancreas is dissected free of fat and lymph nodes, weighed, and spread on bibulus paper for photography. Nodules are counted, and the pancreas is fixed in methacarn, processed for microscopy by conventional methods, step sectioned at 5 µm (about 10 sections per mouse pancreas), stained with hematoxylin and eosin, and examined by light microscopy. Tumors are obtained from MET mice at various time points during tumor progression, fixed in methacarn (60% methanol, 30% chloroform, 10% glacial acetic acid), embedded in paraffin, and sectioned for immunohistochemical analysis. MUC1 antibodies used are CT1, a rabbit polyclonal Ab that recognizes mouse and human cytoplasmic tail region of MUC1, HMFG-2, BC2, and SM-3, which have epitopes in the TR domain of MUC1.

Mice are treated with anti-PDGFRβ/anti-VEGF-A bispecific antibody beginning 3-14 days following tumor implantation, or when tumor engraftment and growth rate is established. Treatment levels of 0.5-5 mg/kg are administered on a daily basis for 5-14 days, and may be continued thereafter if no evidence of neutralizing antibody formation is seen.

EXAMPLE 51

B16-F10 Melanoma Model for Evaluating In Vivo Anti-tumor Effects of Anti-PDGFRβ/Anti-VEGF-A Bispecific Antibody Mice (female, C57B16, 9 weeks old; Charles River Labs, Kingston, N.Y.) are divided into three groups. On day 0, B16-F10 melanoma cells (ATCC No. CRL-6475) are harvested from culture and injected intravenously, via the tail vein, to all mice (about 100,000 cells per mouse). Mice are then treated with the test article or associated vehicle by intraperitoneal injection of 0.1 ml of the indicated solution. Mice in the first group (n=24) are treated with vehicle (PBS pH 6.0), which is injected on day 0, 2, 4, 6, and 8. Mice in the second group (n=24) are treated with an anti-PDGFRβ/anti-VEGF-A bispecific antibody, which is injected at a dose of 75 µg on day 0, 2, 4, 6, and 8. Mice in the third group (n=12) are treated with the anti-PDGFRβ/anti-VEGF-A bispecific antibody, which is injected at a dose of 75 µg daily from day 0 through day 9. All of the mice are sacrificed on day 18, and lungs are collected for quantitation of tumor. Foci of tumor growth greater than 0.5 mm in diameter are counted on all surfaces of each lung lobe. In both groups of mice treated with anti-PDGFRβ/anti-VEGF-A bispecific antibody, the average number of tumor foci present on lungs is significantly reduced, compared to mice treated with vehicle. Mice treated more frequently (i.e. daily) have fewer tumor foci than mice treated on alternate days. These results indicate that treatment with anti-PDGFRβ/anti-VEGF-A bispecific antibody slowed the growth of the B16 melanoma tumors.

EXAMPLE 52

EG.7 Thymoma Model for Evaluating In Vivo Anti-tumor Effects of Anti-PDGFRβ/Anti-VEGF-A Bispecific Antibody Mice (female, C57B16, 9 weeks old; Charles River Labs, Kingston, N.Y.) are divided into three groups. On day 0, EG.7 cells (ATCC No. CRL-2113) are harvested from culture and 1,000,000 cells are injected intraperitoneal in all mice. Mice are then treated with the test article or associated vehicle by intraperitoneal injection of 0.1 mL of the indicated solution. Mice in the first group (n=6) are treated with vehicle (PBS pH 6.0), which is injected on day 0, 2, 4, and 6. Mice in the second group (n=6) are treated with an anti-PDGFRβ/anti-VEGF-A bispecific antibody, which is injected at a dose of 10 µg on day 0, 2, 4, and 6. Mice in the third group (n=6) are treated with the anti-PDGFRβ/anti-VEGF-A bispecific antibody, which is injected at a dose of 75 µg on day 0, 2, 4, and 6. In both groups of mice treated with anti-PDGFRβ/anti-VEGF-A bispecific antibody, time of survival is significantly increased, compared to mice treated with vehicle. These results indicate that treatment with anti-PDGFRβ/anti-VEGF-A bispecific antibody slowed the growth of the EG.7 tumors.

EXAMPLE 53

Mouse Syngeneic Ovarian Carcinoma Model for Evaluating Efficacy of Anti-PDGFRβ/Anti-VEGF-A Bispecific Antibody The effect of anti-PDGFRβ/anti-VEGF-A bispecific antibody is tested for efficacy in ovarian carcinoma using a mouse syngeneic model as described in Zhang et al., *Am. J. of Pathol.* 161:2295-2309, 2002. Briefly, using retroviral transfection and fluorescence-activated cell sorting a C57BL6 murine ID8 ovarian carcinoma cell line is generated that stably overexpresses the murine VEGF$_{164}$ isoform and the enhanced green fluorescence protein (GFP). The retroviral construct containing VEGF$_{164}$ and GFP cDNAs was transfected into BOSC23 cells. The cells are analyzed by FACS cell sorting and GFP high positive cells are identified.

The ID8 VEGF$_{164}$/GFP transfected cells are cultured to subconfluence and prepared in a single-cell suspension in phosphate buffer saline (PBS) and cold MATRIGEL (BD Biosciences, Bedford, Mass.). Six to eight week old femal C57BL6 mice are injected subcutaneously in the flank at 5×10$^6$ cells or untransfected control cells. Alternatively, the mice can be injected intraperitoneally at 7×10$^6$ cells or control cells. Animals are either followed for survival or sacrificed eight weeks after inoculation and evaluated for tumor growth. Mice are treated with an anti-PDGFRβ/anti-VEGF-A bispecific antibody beginning 3-14 days following tumor implantation, or when tumor engraftment and growth rate is established. Treatment levels of 0.5-5 mg/kg are administered on a daily basis for 5-14 days, and may be continued thereafter if no evidence of neutralizing antibody formation is seen.

EXAMPLE 54

Mouse RenCA Model for Evaluating Efficacy of Anti-PDGFRβ/Anti-VEGF-A Bispecific Antibody The efficacy of an anti-PDGFRβ/anti-VEGF-A bispecific antibody in a renal cell carcinoma model is evaluated using BALB/c mice that have been injected with RENCA cells, a mouse renal adenocarcinoma of spontaneous origin, essentially as described in Wigginton et al., *J. Nat. Cancer Instit.* 88:38-43, 1996.

Briefly, BALB/c mice between eight and ten weeks are injected with RenCA cells R $1\times10^5$ cells into the kidney capsule of the mice. Twelve days after tumor cell implantation, the mice are nepharectomized to remove primary tumors. The mice are allowed to recover from surgery, prior to administration of anti-PDGFRβ/anti-VEGF-A bispecific antibody. Mice are treated with anti-PDGFRβ/anti-VEGF-A bispecific antibody beginning 3-14 days following tumor implantation, or when tumor engraftment and growth rate is established. Treatment levels of 0.5-5 mg/kg will be administered on a daily basis for 5-14 days, and may be continued thereafter if no evidence of neutralizing antibody formation is seen. Alternatively, RenCA cells may be introduced by subcutaneous ($5\times10^5$ cells) or intravenous ($1\times10^5$ cells) injection.

The mice are evaluated for tumor response as compared to untreated mice. Survival is compared using a Kaplan-Meier method, as well as tumor volume being evaluated.

EXAMPLE 55

Murine Breast Cancer Model for Evaluating Efficacy of Anti-PDGFRβ/Anti-VEGF-A Bispecific Antibody The efficacy of an anti-PDGFRβ/anti-VEGF-A bispecific antibody in a murine model for breast cancer is made using a syngeneic model as described in Colombo et al., *Cancer Research* 62:941-946, 2002. Briefly, TS/A cells which are a spontaneous mammary carcinoma for BALB/C mice. The cells are cultured for approximately one week to select for clones. The selected TS/A cells are grown and used to challenge CD-1 nu/nu BR mice (Charles River Laboratories) by injected $2\times10^2$ TS/A cells subcutaneously into the flank of the mouse.

Mice are treated with anti-PDGFRβ/anti-VEGF-A bispecific antibody beginning 3-14 days following tumor implantation, or when tumor engraftment and growth rate is established. Treatment levels of 0.5-5 mg/kg are administered on a daily basis for 5-14 days, and may be continued thereafter if no evidence of neutralizing antibody formation is seen. The tumors are excised after sacrificing the animals and analyzed for volume and using histochemistry and immunohistochemistry.

EXAMPLE 56

Transfection and Production of CHO Pools for Protein Production

Plasmid DNA was digested with a restriction enzyme, PvuI. To make a stable CHO pool expressing a BiscFv, 15 μg of digested plasmid DNA were transfected into CHO DXB-11 host cells following a standard electroporation protocol. The cells were allowed to recover in complete medium for two days in a shake flask at 37° C. Following recovery, the cells were transferred into selective medium supplemented with methotrexate. The cells were propagated every three to four days until they were at least 90% viable.

To make a stable CHO pool expressing a BiAb, 15 μg of each digested plasmid DNA were co-transfected into CHO DXB-11 host cells following a standard electroporation protocol. The cells were allowed to recover in complete medium for two days in a shake flask at 37° C. Following recovery, the cells were transferred into complete medium supplemented with puromycin. The cells were propagated every three to four days until they were at least 80% viable. The cells were then transferred into selective medium supplemented with puromycin and methotrexate. The cells were propagated every three to four days until they were at least 90% viable.

When the transfected CHO DXB-11 cells reached a viability of at least 90%, the pool was assayed for recombinant protein production. The pool was seeded into production medium in a shake flask and incubated at 37° C. After six days, the culture was harvested and the supernatant was assayed for recombinant protein production by protein A HPLC.

EXAMPLE 57

Measurement of Binding Affinity of PDGFRβ/VEGF-A Bispecific Molecules for Human Monomeric PDGFRβ by Surface Plasma Resonance Bispecific molecules were evaluated for binding affinity to human monomeric PDGFRβ. Association and dissociation constants were measured for the interaction of the bispecific molecules to PDGFRβ. The binding affinity was measured using these measured constants.

Materials and Methods

Binding kinetics and affinity measurements were performed on a Biacore T-100™ system (GE Healthcare, Piscataway, N.J.). Methods were programmed using the Biacore T-100™ Control Software v1.1.1. All studies were done at 25° C. and samples stored at 8° C. in the autosampler. Goat anti-human IgG Fc-gamma specific antibody was immobilized onto a CM4 sensor chip using a mixture of 0.4 M EDC [N-ethyl-N'-(3-diethylamino-propyl)carbodiimide] and 0.1 M NHS(N-hydroxysuccinimide). The antibody was diluted in 10 mM sodium acetate pH 5.0 to a concentration of 50 μg/mL. The density of immobilization was about 3400-3700 RU. After immobilization, the remaining cells were blocked with ethanolamine and non-specifically bound protein was removed by washing with 50 mM NaOH.

The PDGFRβ/VEGF-A bispecific molecules were diluted into HBS-EP buffer (10 mM HEPES, 150 mM NaCl, 3 mM EDTA, 0.005% surfactant P20, 1 mg/mL BSA, pH 7.4) at 2 μg/mL. They were captured onto individual flow cells of goat anti-human IgG Fc-gamma CM4 chip at 10 μl/min. The density of immobilization was between 83-108 RU.

Monomeric PDGFRβ was injected over flow cells. Serial 1:3 dilutions of the analyte were made in HBS-EP buffer from 100 nM to 0.015 nM. Single injections of the concentration series performed from low to high concentrations, followed by replicate injection of the samples series. The analyte was injected at 30 µl/min for 9 minutes (association time). The dissociation time for each analyte injection was 15 minutes. Buffer injections were also made to subtract for instrument noise and drift.

Data analysis was performed with the Biacore T100 Evaluation software. Based on the binding of the monomeric analyte to the bivalent molecule, the 1:1 binding model was determined to be appropriate, and the resulting binding curves were fit to this model. The 1:1 binding model measures a single value for association constant ($k_a$) and dissociation constant ($k_d$). The overall binding affinity ($K_D$) was obtained by dividing the $k_d$ by $k_a$.

Results

The kinetic constants obtained for the various bispecific molecules are summarized in Table 29. Bispecific molecules with common anti-PDGFRβ family groups showed similar binding affinities and the data fit well to the 1:1 binding model. Most molecules bound to the analyte (monomeric PDGFRβ) with low nM affinity.

TABLE 29

Binding Affinity of Bispecific Molecules to Monomeric PDGFRβ

| Molecule | $k_a$ (1/Ms) | $k_d$ (1/s) | $K_D$ (nM) |
|---|---|---|---|
| c941.1-c868.1 | 5.5E+04 | 1.3E−04 | 2 |
| c941.1-c1039.1 | 4.2E+04 | 4.3E−05 | 1 |
| c1035.1-c868.1 | 4.6E+04 | 5.2E−05 | 1 |
| c1035.1-c870.1 | 4.0E+04 | 4.5E−05 | 1 |
| c1035.1-c1039.1 | 4.7E+04 | 3.7E−05 | 0.8 |
| c597.1-c868.1 | 5.3E+04 | 3.4E−04 | 6 |
| c597.1-c870.1 | 5.3E+04 | 3.7E−04 | 7 |
| c597.1-c1039.1 | 5.6E+04 | 3.7E−04 | 7 |
| c600.1-c868.1 | 3.5E+04 | 1.8E−04 | 5 |
| c600.1-c870.1 | 3.5E+04 | 1.9E−04 | 5 |
| c600.1-c1039.1 | 2.9E+04 | 1.8E−04 | 6 |

EXAMPLE 58

Measurement of Binding Affinity of PDGFRβ/VEGF-A Bispecific Molecules for Recombinant Human VEGF-A by Surface Plasma Resonance Bispecific molecules were evaluated for binding affinity to recombinant human VEGF-A. Association and dissociation constants were measured for the interaction of the bispecific molecules to VEGF-A. The binding affinity was measured using these measured constants.

Materials and Methods

Binding kinetics and affinity measurements were performed on a Biacore 1100™ system (GE Healthcare, Piscataway, N.J.). Methods were programmed using the Biacore T-100™ Control Software v1.1.1. All studies were done at 25° C. and samples stored at 8° C. in the autosampler. Recombinant human VEGF-A was immobilized onto a CM4 sensor chip using a mixture of 0.4 M EDC [N-ethyl-N'-(3-diethylamino-propyl)carbodiimide] and 0.1 M NHS (N-hydroxysuccinimide). The protein was diluted in 10 mM sodium acetate pH 5.0 to a concentration of 2 µg/mL. The density of immobilization was about 13 RU. After immobilization, the remaining cells were blocked with 1 M ethanolamine and non-specifically bound protein was removed by washing with 10 mM glycine, pH 1.5.

The PDGFRβ/VEGF-A bispecific molecules were diluted into HBS-EP buffer (10 mM HEPES, 150 mM NaCl, 3 mM EDTA, 0.005% surfactant P20, 1 mg/mL BSA, pH 7.4). Serial 1:3 dilutions of the analyte were made in HBS-EP buffer from 100 nM to 0.015 nM. The bispecific molecule was injected over flow cells. Single injections of the concentration series performed from low to high concentrations, followed by replicate injection of the samples series. The analyte was injected at 30 µl/min for 9 minutes (association time). The dissociation time for each analyte injection was 15 minutes. Buffer injections were also made to subtract for instrument noise and drift.

Data analysis was performed with the Biacore T100 Evaluation software. Based on the binding of the dimeric bispecific molecule to dimeric human VEGF-A, the bivalent binding model was determined to be appropriate, and the resulting binding curves were fit to this model. The bivalent binding model measures two values for association constant ($k_{a1}$ and $k_{a2}$) and dissociation constant ($k_{d1}$ and $k_{d2}$). The overall binding affinity ($K_{D1}$) was obtained by dividing the $k_{d1}$ by $k_{a1}$.

Results

The kinetic constants obtained for the various bispecific molecules are summarized in Table 30. Bispecific molecules with common anti-VEGF-A family groups showed reasonably similar binding affinities and the data fit well to the bivalent binding model. Most molecules bound to the VEGF-A with low nM affinity.

TABLE 30

Binding Affinity of Bispecific Molecules to Recombinant Human VEGF-A

| Molecule | $k_{a1}$ (1/Ms) | $k_{d1}$ (1/s) | $K_{D1}$ (nM) |
|---|---|---|---|
| c941.1-c868.1 | 3.6E+05 | 4.0E−04 | 1 |
| c941.1-c1039.1 | 2.1E+05 | 2.5E−04 | 1 |
| c1035.1-c868.1 | 7.1E+04 | 1.2E−04 | 2 |
| c1035.1-c1039.1 | 2.1E+05 | 2.1E−04 | 1 |
| c597.1-c868.1 | 3.4E+04 | 1.1E−04 | 3 |
| c597.1-c1039.1 | 5.4E+04 | 1.1E−04 | 2 |
| c600.1-c868.1 | 3.2E+04 | 1.6E−04 | 5 |
| c600.1-c1039.1 | 6.1E+04 | 1.5E−04 | 2 |

EXAMPLE 59

Confirmation of Co-Binding of PDGFRβ/VEGF-A Bispecific Molecules to Both Recombinant Human PDGFRβ and Recombinant Human VEGF-A by Surface Plasma Resonance Bispecific molecules were evaluated for their ability to simultaneously co-bind recombinant human PDGFRβ (monomeric or dimeric) and recombinant human VEGF-A. The molar stochiometry of the co-binding was calculated.

Materials and Methods

Binding kinetics and affinity measurements were performed on a Biacore T-100™ system (GE Healthcare, Piscataway, N.J.). Methods were programmed using the Biacore T-100™ Control Software v1.1.1. All studies were done at 25° C. and samples stored at 8° C. in the autosampler. Recombinant human VEGF-A was immobilized onto a CM4 sensor chip using a mixture of 0.4 M EDC [N-ethyl-N'-(3-diethylamino-propyl)carbodiimide] and 0.1 M NHS (N-hydroxysuccinimide). The protein was diluted in 10 mM sodium acetate pH 5.0 to a concentration of 2 µg/mL. The density of immobilization was about 13 RU. After immobilization, the remaining cells were blocked with 1 M ethanolamine and non-specifically bound protein was removed by washing with 10 mM glycine, pH 1.5.

The PDGFRβ/VEGF-A bispecific molecules were diluted into HBS-EP buffer (10 mM HEPES, 150 mM NaCl, 3 mM EDTA, 0.005% surfactant P20, 1 mg/mL BSA, pH 7.4) at a concentration of 100 nM and was injected over the flow cells at 10 µl/min for 5 minutes. Buffer injections were also made to subtract for instrument noise and drift.

A saturating concentration (500 nM) of either monomeric PDGFRβ or dimeric PDGFRβ-Fc was prepared in HBS-EP buffer and injected over the flow cells. The analyte was injected at 30 µl/min for 10 minutes (association time). Buffer injections were also made to subtract for instrument noise and drift.

Data analysis was performed with the Biacore T100 Evaluation software.

Results

Each bispecific molecule was first allowed to bind to immobilized human VEGF-A and the binding curves formed. Subsequently, PDGFRβ monomer or PDGFRβ-Fc dimer was allowed to bind to the captured and VEGF-A bound bispecific molecule. All bispecific molecules were simultaneously able to bind both VEGF-A and PDGFRβ. The molar stochiometry of binding for the various bispecific molecules are summarized in Table 31.

TABLE 31

Molar stochiometry of binding of VEGF-A bound bispecific molecules to monomeric and dimeric PDGFRβ

| Molecule | Monomeric PDGFRβ | Dimeric PDGFRβ-Fc |
|---|---|---|
| c941.1-c1039.1 | 0.8 to 1 | 0.5 to 1 |
| c1035.1-c868.1 | 1.8 to 1 | 0.8 to 1 |
| c1035.1-c1039.1 | 1.6 to 1 | 0.9 to 1 |
| c597.1-c1039.1 | 1.4 to 1 | 0.8 to 1 |
| c600.1-c1039.1 | 1.1 to 1 | 0.7 to 1 |

(effector-function-negative Fc). Typically, binding of these molecules to FcRn (neonatal Fc receptor) would not be compromised and, therefore, these molecules are expected to have serum half-life (t½) similar to that of classical IgG antibodies. Pharmacokinetic properties of bispecific molecules comprising effector effector-function-negative Fc were determined after single dose i.v. injection in female SCID mice.

Materials and Methods

Female SCID mice (Charles River Laboratories) between 8-10 weeks of age were used for all experiments. Groups of 24 mice were injected via tail vein with 100 µg of bispecific molecule in a 100 µl volume in 25 mM histidine/125 nM NaCl buffer. Whole blood was collected at various time points (0.5, 2, 6, 24, 72, 168, 336, and 504 hrs) from groups of 3 mice by cardiac puncture (in anesthetized mice), serum collected and stored at −80° C. Quantity of bispecific molecule in serum was determined in the various samples using a qualified ELISA.

Recombinant human VEGF-A was immobilized on plastic (96 well flat-bottom plates). Serial dilutions of serum isolated from mice was generated and added to the wells coated with human VEGF-A (capture of bispecific molecules). A biotinylated anti-human IgG antibody was used to bind the Fc portion of the captured bispecific (in serum) followed by detection using streptavidin-horseradish peroxidase in conjunction with the substrate tetramethylbenzidine. A standard curve using fresh bispecific molecule was used to then calculate amount in serum.

The resulting concentration versus time profiles were subjected to noncompartmental PK analysis using WinNonlin 5.0.1 (Pharsight Inc, Mountain view, Calif.). Values for the area under the concentration versus time curves extrapolated to infinity (AUCINF) were calculated using the linear trapezoidal method with uniform weighting.

Results

Bispecific molecule serum concentrations were quantifiable in all samples tested out to the last time point measured (504 hrs post dose). The analyses of these data are shown in Table 32. These results demonstrate that the c1035.1-c1039.1 biscFv and the c597.1-c1039.1 and c600.1-c1039.1 biAbs have serum half-lives in the range expected of Fc-containing classical antibodies.

TABLE 32

Pharmakoinetic Analysis of Bispecific Molecules Following Single Dose I.V. Injection

| Parameter | Units | c1035.1-c1039.1 | c597.1-c1039.1 | c600.1-c1039.1 |
|---|---|---|---|---|
| $C_0$ | µg/mL | 113 | 95.8 | 99.9 |
| $AUC_{0-t}$ | h·µg/mL | 13200 | 12700 | 16900 |
| $AUC_{INF}$ | h * µg/mL | 24300 | 19200 | 28800 |
| $AUC_{\% \, extrapolated}$ | % | 45.7 | 33.8 | 41.3 |
| $AUC_{INF}/D$ | h * µg/mL/µg | 243 | 256 | 288 |
| $t_{1/2, \lambda z}$ | hrs | 460 | 327 | 413 |
| $V_{SS}$ | mL | 2.65 | 1.78 | 1.98 |
| Cl | mL/h | 0.0041 | 0.0039 | 0.0035 |

EXAMPLE 60

Pharmacokinetic Analysis of Bispecific Molecules Following Single Dose Intravenous Injection in Female SCID Mice Bispecific molecules described in the above Examples (see, e.g., Example 30) have the human IgG1 Fc, either wild-type or with mutations that inhibit binding to FcγR

EXAMPLE 61

Serum from Mice after Single Dose Injection of Bispecific Molecule in SCID Mice Neutralizes VEGF-A and PDGFRβ Activity In Vitro The serum from Example 60 was analyzed using a human VEGF-A capture followed by detection using an anti-human IgG Fc antibody ELISA. To further show that the molecules detected in serum are active, the isolated serum were tested for neutralizing activity in assays testing for function of VEGF-A and PDGFRβ activation.
Materials and Methods Serum isolated from the PK draws (0.5 and 504 hr) were diluted in 10% serum and tested for neutralizing activity. For neutralizing activity against VEGF-A, the assay described in Example 11 was used (human VEGF-A induced luciferase activity in 293/VEGFR2 cells). For neutralizing activity against PDGFRβ, PDGF-BB-induced PDGFRβ phosphorylation assay described in Example 22 was used. As controls, freshly spiked bispecific molecules in 10% SCID serum was used to neutralize activity.
Results As shown in Table 33, serum from mice injected with bispecific molecules effectively neutralized human VEGF-A and PDGFRβ activity. Activity was similar to that seen with freshly spiked bispecific molecule in serum. These data show that the bispecific molecules are active in serum for up to at least 504 hrs after a single injection.

TABLE 33

Neutralization of VEGF-A and PDGFRβ Activity In Vitro with Serum from SCID Mice Injected with PDGFRβ/VEGF-A Bispecific Antibodies

| Molecule | Sample | VEGF-A $IC_{50}$ (nM) | | PDGFRβ $IC_{50}$ (nM) | |
|---|---|---|---|---|---|
| | | 0.5 hr | 504 hr | 0.5 hr | 504 hr |
| c1035.1-c1039.1 | Fresh spiked | 0.52 | 0.52 | 0.7 | 0.7 |
| | Mouse #1 | 0.50 | 0.83 | 2.1 | 3.0 |
| | Mouse #2 | 0.54 | 0.51 | 1.9 | 1.9 |
| | Mouse #3 | 0.53 | 0.52 | 1.5 | 1.8 |
| c597.1-c1039.1 | Fresh spiked | 0.41 | 0.44 | 1.4 | 1.4 |
| | Mouse #1 | 0.67 | 1.03 | 1.6 | 3.6 |
| | Mouse #2 | 0.71 | 0.96 | 1.5 | 2.9 |
| | Mouse #3 | ND | 0.67 | ND | 1.4 |

ND = not determined due to technical issues with sample

EXAMPLE 62

Epitope Mapping of Anti-VEGF-A Antibodies

Monoclonal human VEGF-A antibodies produced by clone c636, c868, c870 and c1039 were evaluated for their peptide binding to human VEGF-A using the JPT VEGF-A RepliTope™ slides.
Material and Methods Each JPT slide consisted of 3 replicates of the following array. Each array consisted of successive, overlapping 13aa fragments of VEGF-A (spots 1-78), followed by successive, overlapping 20aa fragments of VEGF-A (spots 85-115). In addition, control spots of each test antibody and mouse and human IgG flanked top, bottom, and sides of each array.

A series of experiments were completed to determine the binding ability of scFvs c636, c870, c1039, and c868 against the synthetic linear peptides of human VEGF-A protein. The anti-human VEGF-A scFvs were labeled with His/Myc epitope tags. A solution of 10-100 µg/ml of the antibodies were applied to the peptide slides. Anti-His and/or anti-Myc antibodies were then applied to the slides. Signals were amplified with the Biotinylated Tyramide according to the method specified by the kit (Renaissance® TSA™ Biotin System, PerkinElmer, #NEL700A). The bound antibodies were visualized using a streptavidin alkaline phosphatase and a DAKO Permanent Red dye.

Data was compiled using a home-made microscope slide scanner consists of a Nikon Eclipse TE2000U Inverted microscope, an ASI MS-2000 motorized stage, a Photometrics Cascade II 512 camera and a X-cite 120 fluorescent illumination system. The signal intensity was analyzed using the MetaMorph v7.1 imaging software.
Results The positions and sequences of the binding peptides are shown in Table 34 below. The numbers indicate the percentage signal intensity of the peptide respect to overall signal intensities.

TABLE 34

Binding of Anti-VEGF-A Antibodies to VEGF-A-derived Peptides

| Peptide ID | Peptide Sequence | Functional unit | c1039 | c636 | c868 | c870 |
|---|---|---|---|---|---|---|
| 7 | HEVVKFMDVYQRS (SEQ ID NO: 544) | α1 | 3% | 7% | 6% | 4% |
| 8 | VVKFMDVYQRSYS (SEQ ID NO: 545) | α1 | 6% | 14% | 9% | 14% |
| 9 | KFMDVYQRSYSHP (SEQ ID NO: 546) | α1 | 7% | 15% | 10% | 17% |
| 10 | MDVYQRSYSHPIE (SEQ ID NO: 547) | α1 | 5% | | | |
| 11 | VYQRSYSHPIETL (SEQ ID NO: 548) | α1 | 7% | | 12% | 6% |
| 18 | DIFQEYPDEIEYI (SEQ ID NO: 549) | α2 | 3% | | | |
| 19 | FQEYPDEIEYIFK (SEQ ID NO: 550) | α2 | 5% | 4% | | |
| 20 | EYPDEIEYIFKPS (SEQ ID NO: 551) | β2 | 3% | | | |

TABLE 34-continued

Binding of Anti-VEGF-A Antibodies to VEGF-A-derived Peptides

| Peptide ID | Peptide Sequence | Functional unit | c1039 | c636 | c868 | c870 |
|---|---|---|---|---|---|---|
| 23 | EYIFKPSSVPLMR (SEQ ID NO: 552) | α2-β2 | 9% | 18% | 14% | 32% |
| 24 | IFKPSSVPLMRSG (SEQ ID NO: 553) | α2-β2 | 7% | 15% | 9% | 25% |
| 34 | LESVPTEESNITM (SEQ ID NO: 554) | β4-β5 | | | | |
| 36 | PTEESNITMQIMR (SEQ ID NO: 555) | β4-β5 | | 5% | 6% | |
| 37 | EESNITMQIMRIK (SEQ ID NO: 556) | β5 | 4% | 3% | 4% | |
| 38 | SNITMQIMRIKPH (SEQ ID NO: 557) | β5 | | 3% | | |
| 39 | ITMQIMRIKPHQG (SEQ ID NO: 558) | β5 | 3% | 6% | 6% | 1% |
| 41 | IMRIKPHQGQHIG (SEQ ID NO: 559) | β5-β6 | | 8% | 7% | |
| 59 | PSGPSSERRKHLF (SEQ ID NO: 560) | postβ7 * | 13% | 3% | 20% | |
| 60 | GPSSERRKHLFVQ (SEQ ID NO: 561) | postβ7 * | 5% | | | |
| 75 | ARQLELNERTSRS (SEQ ID NO: 562) | postβ7 * | 7% | | | |
| 76 | QLELNERTSRSDK (SEQ ID NO: 563) | postβ7 * | 4% | | | |
| 77 | ELNERTSRSDKPR (SEQ ID NO: 564) | postβ7 * | 4% | | | |
| 78 | LNERTSRSDKPRR (SEQ ID NO: 565) | postβ7 * | 4% | | | |

* The region "post β7" is the heparin binding domain of the VEGF molecule.

All 4 tested antibodies showed a specific binding site around the α2-β2 region. The data indicated that the testing antibodies could be classified into two categories: antibody c636 and c870 preferred the C-terminal side of VEGF-A, while antibody c1039 and c868 had the stronger binding towards the N-terminal side of the protein. Antibody c870 had the fewest binding peptides while antibody c1039 had the most dispersed binding pattern. The top two binding sites from each antibody are listed in Table 35 below.

TABLE 35

Top Anti-VEGF-A Binding Sites

| Binding ranks | c1039 | c636 | c868 | c870 |
|---|---|---|---|---|
| 1 | postβ7 | α2-β2 | postβ7 | α2-β2 |
| 2 | α2-β2 | α1 | α2-β2 | α1 |

EXAMPLE 63

Epitope Mapping of Anti-PDGFRβ Antibodies

Summary

The purpose of this study was to determine the binding sites of anti-PDGFRβ molecules using a peptide microarray immunoassay. In this study, the JPT Peptide Microarray technology was used to evaluate five anti-PDGFR-β molecules: anti-PDGFRβ Fab c597, anti-PDGFRβ scFv c1035, anti-PDGFRβ scFv c941, anti-PDGFRβ IgG1 c600, PDGFRβ scFv c1232, and a mouse anti-PDGFRβ monoclonal antibody (E9899).

Materials and Methods

RepliTope™ peptide microarray was prepared as a series of overlapping peptide fragments of human PDGFRβ (20 aa overlaps and 5 aa shifts). Both control spots and peptides were printed in three identical replicate arrays per slide for intra-plate reproducibility. All peptides and the control antibodies including the binding molecules are covalently attached by selective immobilization chemistry using the amino-function of the lysine-side chains. The control spots consisted of: human IgG, goat IgG, mouse IgG, c1035 scFv, c597 Fab and c941 scFv.

Epitope mapping was determined by detecting anti-PDGFRβ molecule binding to human PDGFRβ on Repli-Tope™ slides. As an additional control, a mouse anti-human PDGFRβ monoclonal antibody (E9899; +control) and anti-VEGF-A scFv (−control) were tested. Prior to running slides, each anti-PDGFRβ molecule was tested on a dot blot to determine approximate working concentrations of primary and secondary antibodies. Each experiment was run in duplicate.

RepliTope™ slides were incubated for one hour with anti-PDGFRβ molecules diluted with PB. The His6 labeled anti-PDGFRβ molecules (c1035, c941, c597 and c1232) were stained with an anti-His6 secondary antibody as described in the method outline below. c600, an anti-PDGFRβ IgG1 was stained with a goat anti-human F(ab')$_2$ fragment Fcγ specific secondary antibody. E9899, a mouse monoclonal, was stained with a goat anti-mouse F(ab')$_2$ fragment Fcγ specific secondary.

Following the biotinylated tyramide and strep-avidin incubations and subsequent TNT wash steps, the slides were developed with DAKO permanent red by incubating at RT until spots became visible but before background staining developed (1-30 min). Color development was stopped by rinsing with dH$_2$O, Slides were dried with nitrogen and peptide spots were visualized with both a bright field and a fluorescent microscope. Plate images were scanned under 4× magnification using fluorescence imaging and MetaMorph software version 7.1. Images were visualized to facilitate analysis of the anti-PDGFRβ binding peptides using Adobe Photoshop. Binding peptide spots were manually determined and confirmed by visual analysis. Results of the peptide microarray analysis are summarized in Table 36 below.

EXAMPLE 64

Identification of Neutralizing Anti-VEGF Bispecific Antibodies Using the 293/KDR/KZ136/c22 VEGF-A-induced Cell-based Luciferase Assay To screen bispecific molecules for their ability to neutralize the activity of VEGF-A, a cell-based luciferase assay was performed. 293/KDR/KZ136/c22 cells were plated at a seeding density of 10,000 cells per well in 96-well opaque white tissue-culture treated plates (Costar #3917) in 100 μl complete medium (DMEM, 10% fetal bovine serum (FBS), 1× Sodium Pyruvate, 1× GlutaMax (Invitrogen)) and incubated 48 hours in a 37° C. humidified 5% CO$_2$ incubator. After 48 hours, complete medium was removed by vacuum aspiration and replaced with 100 μl serum-free medium (DMEM, 1× Sodium Pyruvate, 1× GlutaMax (Invitrogen)) and incubated overnight. The following day, candidate VEGF-A neutralizing molecules were serially diluted from 200 nM down to 12 pM at 1:5 dilutions along with a non-neutralizer (medium only) in serum-free medium. To these, and equal volume of VEGF-A$_{165}$ was added at 0.54 nM for a final concentration of 0.26 nM VEGF-A and 100 nM to 6 pM neutralizing molecule or positive control.

These were incubated for 60 minutes at 37° C. Following incubation, medium was aspirated off the serum-starved cells and 100 μl of the above complexes were added and incubated at 37° C. for 4 hours.

Following 4 hour incubation, a luciferase assay was performed using the Luciferase Assay System (Promega, E1501) according to the manufacturer's instructions. Briefly, medium was aspirated and 25 μl 1× is Buffer (Promega, E153A) was added to each well. Plates were

TABLE 36

Binding Peptide Sequences of Human PDGFRβ as Determined by JPT Peptide Microarray

| Antibody | Peptide amino acid sequence | Peptide Spot No. | Ig-like domain |
|---|---|---|---|
| Anti-PDGFRβ scFv, (c1035) | $^{186}$RSYISKTT1GDREVDSDAYY$^{205}$ (SEQ ID NO: 566) | 38 | D2 |
|  | $^{191}$KTTIGDREVDSDAYYVYRLQ$^{210}$ (SEQ ID NO: 567) | 39 | D2 |
|  | $^{196}$DREVDSDAYYVYRLQVSSIN$^{215}$ (SEQ ID NO: 568) | 40 | D2, D2/D3 loop |
|  | $^{251}$RKESGRLVEPVTDFLLDMPY$^{270}$ (SEQ ID NO: 569) | 51 | D3 |
| Anti-PDGFRβ Fab, (c597) | $^{251}$RKESGRLVEPVTDFLLDMPY$^{270}$ (SEQ ID NO: 569) | 51 | D3 |
| Anti-PDGFRβ IgG1, (c600) | $^{251}$RKESGRLVEPVTDFLLDMPY$^{270}$ (SEQ ID NO: 569) | 51 | D3 |
| Anti-PDGFRβ scFv, (c941) | $^{156}$LVVTLHEKKGDVALPVPYDH$^{175}$ (SEQ ID NO: 649) | 32 | D2 |
|  | $^{191}$KTTIGDREVDSDAYYVYRLQ$^{210}$ (SEQ ID NO: 567) | 39 | D2 |
|  | $^{231}$ITLMCIVIGNEVVNFEWTYP$^{250}$ (SEQ ID NO: 650) | 47 | D3 |
|  | $^{251}$RKESGRLVEPVTDFLLDMPY$^{270}$ (SEQ ID NO: 569) | 51 | D3 | incubated for 20-30 minutes at RT to equilibrate. Luciferase activity was measured using a microplate luminometer (Berthold Technologies), 40 µl substrate injection, 1 second integration time. Data was analyzed using analytical software (Spotfire) and $IC_{50}$ values were calculated for each candidate and control.

The act of VEGF-$A_{165}$ binding to its receptor, VEGFR2 (KDR/Flk-1), induces a signaling cascade that activates STAT (signal transducer and activator of transcription) and/or SRE (serum-response element), which drives transcription of the luciferase reporter gene. A decrease in luciferase activity indicates that this VEGF-A-mediated signaling is being neutralized.

Results

Significant inhibition was demonstrated with a number of bispecifics screened (reported as $IC_{50}$ values in Tables 37). IC50 values are indicated as nM concentration of bispecific needed to neutralize VEGF-activity by 50%.

TABLE 37

Bispecific Molecules Neutralize Human VEGF-A-induced Luciferase Activity in 293/KDR/KZ136/c22 Cells

| Molecules | $IC_{50}$ (nM) |
| --- | --- |
| Avastin ™ | 0.3 |
| c597-c868 | 0.17 |
| c597-c870 | 0.13 |
| c597-c1039 | 0.09 |
| c600-c868 | 0.18 |
| c600-c870 | 0.07 |
| c600-c1039 | 0.03 |
| c1035-c868 | 0.2 |
| c1035-c870 | 0.05 |
| c1035-c1039 | 0.17 |
| c941-c868 | 0.28 |
| c941-c1039 | 0.21 |

EXAMPLE 65

Proliferation Assay to Determine Neutralizing Activity of Anti-VEGF-A BiAbs and BiscFvs on VEGF-A-stimulated HUVEC Cells To screen for neutralizing anti-VEGF-A bispecifics (BiAbs and BiscFvs) that had a moderate affinity for VEGF-A, a $^3$H-thymidine assay was run. Recombinant human VEGF-$A_{165}$ was used as a positive control at 2.6 nM. DMEM-F12 (1:1) media with 1× insulin-transferrin-selenium (serum-free media, SFM; Invitrogen, Carlsbad, Calif.) was used as a negative control. Bispecific molecules were serially diluted in SFM at 500 nM, 50 nM, 5 nM, 0.5 nM, 0.05 nM, 0.005 nM, and 0.0005 nM. Human umbilical vein endothelial cells (HUVEC) were plated into 96-well flat bottom plates in a volume of 100 µL at a density of 900-1000 cells per well. The HUVEC cells were plated for 2 days in complete EGM-2 MV media (Lonza, Walkersville, Md.) at 37° C., 5% $CO_2$. The cells were serum-starved with SFM for 24 h, stimulated for 24 h with 2.6 nM with or without the serially diluted VEGF-A scFv, and pulsed for 24 h with 1 µCi per well of 3H thymidine, which is incorporated into proliferating cells (all at 37° C., 5% $CO_2$). The cells were harvested and counted using Topcount instrument (Hewlett Packard).

Results

A large number of bispecifics screened in the assay showed potent neutralization of VEGF-induced HUVEC proliferation, as seen by low nM $IC_{50}$ values shown in Tables 38 and 39 below.

TABLE 38

Anti-VEGF-A BiAb and Dimer Neutralizing Activity in HUVEC Proliferation Assay

| BiAbs and dimers | Proliferation $IC_{50}$ (nM) |
| --- | --- |
| c597-c1111 | 0.13 |
| c597-c868 | 0.21-0.60 |
| c868 dimer | 0.22 |
| c600-c868 | 0.75 |
| c597-c870 | 0.34-0.77 |
| c600-c870 | 0.73 |
| c597-c1039 | 0.04-0.54 |
| c600-c1039 | 0.46-0.52 |
| c597-c1081 | 10.08 |
| c597-c1092 | 2.33 |

TABLE 39

Anti-VEGF-A Bisc Neutralizing Activity in HUVEC Proliferation Assay

| BiscFvs | Proliferation $IC_{50}$ (nM) |
| --- | --- |
| c941-c868 | 0.99 |
| c1035-c868 | 0.49-0.72 |
| c1035-c870 | 1.1 |
| c941-c1039 | 0.57-0.84 |
| c1035-c1039 | 0.44-0.59 |

EXAMPLE 66

Testing Cross-reactivity of VEGF-A-binding scFvs and Bispecific Antibodies Against Murine VEGF-A Using the VEGFR2 Phosphorylation Assay To screen candidate molecules (scFvs, Fabs, and bispecifics) for their ability to neutralize the activity of murine VEGF-A, a cell-based luminex assay that measures VEGFR2 (KDR/Flk-1) phosphorylation was performed. Since mVEGF-$A_{164}$ will cross-react to human VEGFR2, a human VEGFR2-based reporter system can be utilized. 293/KDR/KZ136/c22 cells were plated at a density of 20,000 cells per well in 100 µl complete medium (DMEM, 10% fetal bovine serum (FBS), 1× Sodium Pyruvate, 1× GlutaMax (Invitrogen)) in clear 96-well tissue culture plates and allowed to attach overnight. The following day, complete medium was removed by vacuum aspiration and replaced with 100 µl serumfree medium (DMEM, 1× Sodium Pyruvate, 1× GlutaMax). Cells were incubated overnight.

The following day, candidate VEGF-A neutralizing molecules (scFvs, Fabs) were serially diluted from 200 nM down to 12 pM at 1:5 dilutions along with a non-neutralizer (mediumonly) in serum-free medium. VEGFR2-Fc was used as a positive control for neutralization. To these, and equal volume of mVEGF-$A_{164}$ (493-MV-005, R&D Systems) was added at 0.54 nM for a final concentration of 0.26 nM VEGF-A and 100 nM to 6 pM neutralizing molecule or positive control. These were incubated for 60 minutes at 37° C.

Following incubation, medium was removed from serum-starved cells by vacuum aspiration and replaced with 100 µl of above complexes. Cells were incubated for 10 minutes at 37° C. Following incubation, medium was removed by vacuum aspiration and cells were gently washed with 100 µl ice-cold phosphate-buffered saline (PBS, Invitrogen). PBS was removed by vacuum aspiration and cells were lysed in 25 μl NP-40 lysis buffer (Invitrogen Cat.# FNN0021) containing 1 mM PMSF (Sigma, P-2714 in DMSO) and 1 Complete Mini tablet per 10 mL (Roche, 11836153001).

Lysates were incubated for 20 minutes at 4° C. on a platform shaker and centrifuged at 3000 rpm for 10 min at 4° C. to clear lysates. Lysates were transferred to a fresh 96-well microtiter plate and placed at −20° C. until assay.

For the VEGFR2 phosphorylation luminex assay, the Intracellular Protein Buffer Reagent Kit (Invitrogen LHB0002) and VEGFR2 [pY1059] Antibody Bead Kit (Invitrogen LHO0601) was used according to manufacturer's instructions. Lysates were thawed and mixed 1:5 with 80 μl Assay Diluent. Wells of a luminex vacuum filtration plated were pre-wetted with 200 μl Working Wash Solution. Diluted beads were added at 25 μl per well and washed 2× with 200 μl Working Wash Solution. Following washing, 50 μl of diluted lysate, and 50 μl of diluted detector antibody was added to each well and plates were covered in foil and incubated for 3 hours at room temperature (RT) on a platform shaker at 500 rpm. Following incubation, beads were washed 2× with 200 μl Working Wash Solution and then 100 μl of diluted Anti-Rabbit IgG-RPE was added to each well and plates were covered in foil and incubated for 30 minutes at RT on a platform shaker at 500 rpm. Following incubation, beads were washed 3× with 200 μl Working Wash Solution, and resuspended in 125 μl Working Wash Solution. Beads were resuspended for 30 seconds on a platform shaker at 500 rpm and read in Luminex-100 instrument (BioRad). Data was analyzed using analytical software (Spotfire) and $IC_{50}$ values were calculated for each candidate and control.

Results

The act of VEGF-$A_{164}$ binding to human receptor, VEGF-R2 (KDR/Flk-1), induces phosphorylation of the receptor. This luminex-based assay binds total VEGF-R2 to a fluorescently labeled bead conjugated to an anti-VEGFR2 antibody. A secondary antibody detecting phosphorylation at [pY1059] is used to detect how much VEGFR2 has been phosphorylated. As shown in Table 40 below, a number of scFvs that neutralized human VEGF-A activity also inhibited mouse VEGF activity in this assay. Bispecific antibodies that contained these same scFvs also neutralized mouse VEGF-A activity.

TABLE 40

Neutrlaization of Mouse VEGF-A Activity by VEGF-A-specific scFvs and Bispecific Antibodies

| scFv/Bispecific Antibody | $IC_{50}$ (nM) |
| --- | --- |
| c868 | n/a |
| c870 | 0.16 |
| c636 | 0.28 |
| c1036 | 0.22 |
| c1090 | 0.27 |
| c1044 | 0.09 |
| c1155 | 0.19 |
| c1476 | n/a |
| c1410 | 0.24 |
| c1094 | 0.55 |
| c1135 | 0.12 |
| c1257 | n/a |
| c1270 | n/a |
| c1080 | 0.07 |
| c1039 | n/a |
| c1035/c1039 biscFv | n/a |
| c1035/c868 biscFv | n/a |
| c597/c870 biAb | 0.16 | n/a = no clear activity identified

EXAMPLE 67

Proliferation Assay to Determine Neutralizing Activity of scFvs on Mouse VEGF-A VEGF-$A_{164}$-stimulated HUVEC Cells To screen for mouse VEGF-A neutralizing scFvs, a $^3$H-thymidine assay was run. Recombinant mouse VEGF-$A_{164}$ was used as a positive control at 2.6 nM. DMEM-F12 (1:1) media with 1× insulin-transferrin-selenium (serum-free media, SFM; Invitrogen, Carlsbad, Calif.) was used as a negative control. scFv molecules were serially diluted in SFM at 500 nM, 50 nM, 5 nM, 0.5 nM, 0.05 nM, 0.005 nM, and 0.0005 nM. Human umbilical vein endothelial cells (HUVEC) were plated into 96-well flat bottom plates in a volume of 100 μl at a density of 900-1000 cells per well. The HUVEC cells were plated for 2 days in complete EGM-2 MV media (Lonza, Walkersville, Md.) at 37° C., 5% $CO_2$. The cells were serum-starved with SFM for 24 h, stimulated for 24 h with 2.6 nM with or without the serially diluted VEGF-A scFv, and pulsed for 24 h with 1 μCi per well of $_3$H thymidine, which is incorporated into proliferating cells (all at 37° C., 5% $CO_2$). The cells were harvested and counted using Topcount instrument (Hewlett Packard).

Results

A large number of scFvs screened in the assay showed potent neutralization of mouse VEGF-induced HUVEC proliferation, as seen by low nM $IC_{50}$ values shown in the Table 41 below.

TABLE 41

Neutrlaization of Mouse VEGF-A-induced HUVEC proliferation by VEGF-A-specific scFvs

| scFv | $IC_{50}$ (nM) |
| --- | --- |
| c868 | n/a |
| c870 | 0.36 |
| c636 | n/a |
| c1036 | 0.46 |
| c1090 | 0.59 |
| c1044 | 0.79 |
| c1155 | 0.41 |
| c1476 | n/a |
| c1410 | nd |
| c648 | 974 |
| c1094 | 2.84 |
| c1135 | 0.51 |
| c1257 | 637 |
| c1270 | n/a |
| c1080 | 0.44 |

EXAMPLE 68

Luminex Assay to Determine Cross Reactivity of Anti-PDGFRβ sFab and scFv to Mouse PDGFRβ

To screen for cross reactivity of human PDGFRβ scFvs, a Luminex based assay was performed. The assay detects the amount of phosphorylated PDGFRβ that is present in cell lysates. Murine embryonic fibroblasts (3T3-Swiss albino, Swiss; American Type Culture Collection, Manassas, Va.) were seeded in 96 well flat bottom plates (Falcon, Colorado Springs, Colo.) at a density of 1,000 cells per well in a volume of 100 μl in complete media (Dulbecco's Modified Eagle Medium (DMEM), 5% fetal bovine serum (FBS)) and incubated at 37° C. in 5% $CO_2$. After 24-48 hours, complete media was replaced with DMEM-F12 (1:1) media with 1× insulin-transferrin-selenium (Invitrogen, Carlsbad, Calif.; serum-free media, SFM) and cells were incubated as before for an additional 18-24 hours. PDGFRβ-neutralizing molecules (scFvs, Fabs) or the control molecule murine PDGFRβ-human Fc chimera (R&D Systems, #1042-PR-100) were serially diluted 1:4 from 2000 nM to 0.02 nM in SFM. Serum-starved cells were incubated with 150 µl of SFM or the titrated anti-PDGFRβ molecules in SFM for 1 hour at 37° C. in 5% $CO_2$. Cells were then pulsed with 50 µl 1.6 nM PDGF-BB (0.4 nM final concentration, $EC_{80}$, 80% effective concentration) for 10 minutes at 37° C. in 5% $CO_2$. Control wells without PDGF-BB stimulation were included. The cells were then washed with Bio-Plex Cell Wash Buffer and lysed in Lysis Buffer supplied in the assay kit according to the manufacturer's directions (BioRad, Hercules, Calif.), and the cell supernatants were frozen at −20° C. To thawed cell supernatants, 1× phospho-PDGFRβ beads were added and incubated at room temperature on a shaker for 18 h. Detection antibody was added to the washed beads and incubated at room temperature on a shaker for 30 minutes, and then streptavidin-PE was incubated with the beads at room temperature for 15 minutes. The beads were resuspended in Bio-Plex Resuspension Buffer and analyzed on a Bio-Plex array reader (Bio-Rad Laboratories).

Results: None of the analyzed scFvs or Fabs were neutralizing against mouse PDGFRβ.

EXAMPLE 69

Identification of Neutralizing BiscFv and BiAb Against PDGFRβ Using a PDGF-induced Fibroblast Proliferation Assay To screen bispecific candidate molecules (biscs, biAbs) for their ability to neutralize proliferation induced by PDGF-AB, -BB, -CC and -DD activation of the human PDGFRβ human dermal fibroblasts, a $^3$H-thymidine assay was run. The assay measures the amount of radio-labeled nucleotide incorporated into the DNA of proliferating cells. Human Dermal Fibroblasts (HDF) were seeded in 96 well flat-bottom plates (Falcon, Colorado Springs, Colo.) at a density of 1000-1500 cells/well in 100 µl complete media (MEMα (Invitrogen, Carlsbad, Calif.)+10% Fetal Bovine Serum) at 37° C. in 5% $CO_2$. After 24 hours, complete media was replaced with DMEM-F12 (1:1) media with 1× insulin-transferrin-selenium, 0.1% bovine serum albumin fraction V, 1 mM Na Pyruvate, 2 mM L-glutamine (Invitrogen, Carlsbad, Calif.; serum-free media, SFM) and cells were incubated as before for an additional 18-24 hours. Bispecific molecules (biscFvs, biAbs) or a control monoclonal antibody against PDGFRβ (E9899) were serially diluted 1:10 from 200 nM to 0.002 nM in SFM in the presence of a constant level of human PDGF-BB (0.2 nM, $EC_{80}$, 80% effective concentration), human PDGF-AB (3 nM, EC80, R&D systems), human PDGF-CC (1 nM, $EC_{80}$) or human PDGF-DD (0.2 nM, $ED_{80}$). Serum-starved cells were incubated with 100 µl of SFM, PDGF ligands at $EC_{80}$ in SFM, or the titrated anti-PDGFRβ molecules with PDGF ligands at $EC_{80}$ in SFM. After 6-8 hours, 1 µCi $^3$H-thymidine (Amersham, Piscataway, N.J.) was added to each well and cells were incubated as normal for 18-24 hours. Cells were harvested onto filter plates and incorporation of $^3$H-thymidine was determined using a Packard Topcount machine.

Results

BiscFvs and BiAbs showed potent neutralization of human primary fibroblast proliferation induced by ligands PDGF-AB, -BB, -CC and -DD as shown by low nM $IC_{50}$ values in Table 42 below. The neutralization of PDGF-AB and PDGF-CC induced proliferation of HDFs indicates that the bispecific molecules not only neutralize PDGFRβ homodimer but also PDGFRβ/PDGFRα heterodimer.

TABLE 42

Neutralization of PDGF-induced Human Fibroblast Proliferation by PDGFRb-specific BiscFvs and BiAbs

| | $IC_{50}$ (nM) | | |
|---|---|---|---|
| | PDGF-AB | PDGF-BB | PDGF-CC |
| BiscFvs | | | |
| 162.62.62 | 0.178 | 0.13-0.55 | 4.12 |
| c1035.1/c868.1 | 0.06 | 0.2-0.5 | 0.09 |
| c1035.1/c1039.1 | 0.13 | 0.09 | ND |
| Biabs | | | |
| c597.1/c1039.1 | ND | 0.22 | ND |
| c600.1/c1039.1 | ND | 0.37 | ND |

ND: Not determined

EXAMPLE 70

Identification of Neutralizing BiscFv and BiAb Against PDGFRβ Using a PDGF-Bb-induced Pericyte Proliferation Assay To screen candidate bispecific molecules (biscFvs, biAbs) for their ability to neutralize proliferation induced by PDGF-BB activation of the human PDGFRβ, a $^3$H-thymidine assay was run. The assay measures the amount of radio-labeled nucleotide incorporated into the DNA of proliferating cells. Human Brain Vascular Pericytes (HBVP; ScienCell Research, San Diego, Calif.) were seeded in 96 well flat-bottom plates (Falcon, Colorado Springs, Colo.) at a density of 500-2000 cells/well in 150 µl complete media (ScienCell Pericyte Media (PM) plus ScienCell supplements Fetal Bovine Serum, Pericyte Growth Supplement, and Penicillin-Streptomycin) at 37° C. in 5% $CO_2$. After 24-48 hours, complete media was replaced with DMEM-F12 (1:1) media with 1× insulin-transferrin-selenium (Invitrogen, Carlsbad, Calif.; serum-free media, SFM) and cells were incubated as before for an additional 18-24 hours. PDGFRβ-neutralizing molecules (biscFvs or biAbs), a control monoclonal antibody against PDGFRβ (E9899), or the Fab fragment of the E9899 monoclonal antibody were serially diluted 1:4 from 2000 nM to 0.02 nM in SFM in the presence of a constant level of human PDGF-BB (0.4 nM, $EC_{80}$, 80% effective concentration). Serum-starved cells were incubated with 150 µl of SFM, 0.4 nM PDGF-BB in SFM, or the titrated aPDGFRβ molecules with 0.4 nM PDGF-BB in SFM. After 18-24 hours, 1 µCi $^3$H-thymidine (Amersham, Piscataway, N.J.) was added to each well and cells were incubated as normal for 3-6 hours. Cells were harvested onto filter plates and incorporation of 3H-thymidine was determined using a Packard Topcount machine.

Results

BiscFvs and BiAbs showed potent neutralization of pericyte proliferation induced by PDGF-BB as shown by low nM $IC_{50}$ values in Tables 43 and 44 below.

TABLE 43

Neutralizing Activity of BiAb Bispecific
Molecules in PDGF-BB Induced Pericyte Proliferation

| BiAb | $IC_{50}$ (nM) |
|---|---|
| 162.6262 | 0.05-0.48 |
| c597.1-c868.1 | 0.05-1 |
| c597.1-c870.1 | 0.66 |
| c597-c1039 | 0.02-0.5 |
| c600-c868 | 0.04-1.2 |
| c600-c870 | 0.66 |
| c600-c1039 | 0.09-0.1 |

TABLE 44

Neutralizing Activity of BiscFv Bispecific
Molecules in PDGF-BB Induced pericyte proliferation

| BiscFv | $IC_{50}$ (nM) |
|---|---|
| c1035-c868 | 0.02-1.02 |
| c1035-c1039 | 0.2-1.7 |
| c941-c1039 | 0.02-0.6 |

EXAMPLE 71

Identification of Neutralizing Bispecific Antibodies Against PDGFRβ Using a PDGF-DD-induced Pericyte Proliferation Assay To screen candidate bispecific molecules for their ability to neutralize proliferation induced by PDGF-DD activation of the human PDGFRβ, a $^3$H-thymidine assay was run. The assay measures the amount of radio-labeled nucleotide incorporated into the DNA of proliferating cells. Human Brain Vascular Pericytes (HBVP; ScienCell Research, San Diego, Calif.) were seeded in 96 well flat-bottom plates (Falcon, Colorado Springs, Colo.) at a density of 500-2000 cells/well in 150 µl complete media (ScienCell Pericyte Media (PM) plus ScienCell supplements Fetal Bovine Serum, Pericyte Growth Supplement, and Penicillin-Streptomycin) at 37° C. in 5% $CO_2$. After 24-48 hours, complete media was replaced with DMEM-F12 (1:1) media with 1× insulin-transferrin-selenium (Invitrogen, Carlsbad, Calif.; serum-free media, SFM) and cells were incubated as before for an additional 18-24 hours. PDGFRβ-neutralizing molecules (biscFvs), a control monoclonal antibody against PDGFRβ (E9899), were serially diluted 1:4 from 2000 nM to 0.02 nM in SFM in the presence of a constant level of human PDGF-DD (0.2 nM, $EC_{80}$, 80% effective concentration) or human PDGF-BB (0.4 nM $EC_{80}$, 80% effective concentration). Serum-starved cells were incubated with 150 µl of SFM, 0.4 nM PDGF-BB or 0.2 nM PDGF-DD in SFM, or the titrated bispecific molecules with 0.2 nM PDGF-DD or 0.4 nM PDGF-BB in SFM. After 18-24 hours, 1 µCi $^3$H-thymidine (Amersham, Piscataway, N.J.) was added to each well and cells were incubated as normal for 3-6 hours. Cells were harvested onto filter plates and incorporation of $^3$H-thymidine was determined using a Packard Topcount machine.

Results

The BiscFvs, c1035/c868 and c1035/c1039, and the BiAb, c600/c1039, showed potent neutralization of PDGF-DD induced pericyte proliferation as shown by low nM $IC_{50}$ values in in Table 45 below.

TABLE 45

Neutralization of PDGF-induced Pericyte
Proliferation by PDGFRβ-specific BiscFv

| | $IC_{50}$ (nM) | |
|---|---|---|
| Antibody | PDGF-BB | PDGF-DD |
| 162.62.62 | 0.36 | 0.04 |
| c1035.1/c868.1 | 1.3 | 0.29 |
| c1035/c1039 | 0.2 | 0.1 |
| c600/c1039 | 0.1 | 0.2 |

EXAMPLE 72

Identification of Neutralizing sFab and scFv Against PDGFRβ Using a Luminex-based Assay to Determine PDGFRβ Phosphorylation on Pericytes To screen for a neutralizing human PDGFRβ scFv a Luminex based assay was performed. The assay detects the amount of phosphorylated PDGFRβ that is present in cell lysates. Human Brain Vascular Pericytes (ScienCell Research, San Diego, Calif.) were seeded in 96 well flat bottom plates (Falcon, Colorado Springs, Colo.) at a density of 7,500 cells per well in a volume of 100 µl in complete media (ScienCell Pericyte Media (PM) plus ScienCell supplements Fetal Bovine Serum, Pericyte Growth Supplement, and Penicillin-Streptomycin) at 37° C. and 5% $CO_2$. On day two media was changed to ScienCell PM without supplements and serum starved for 24 hours. On day three media was removed from cells and serially diluted bispecific antibodies and control monoclonal antibody to human PDGFRβ (E9899) were added in assay media (ScienCell PM and 0.5% bovine serum albumin) in a volume of 50 µl and incubated for 60 minutes at 37° C. and 5% $CO_2$. PDGF-BB was added in 50 µl at 2× concentration to give a final concentration of 0.44 nM ($EC_{80}$, effective concentration at 80 percent) and incubated for 10 minutes at 37° C. and 5% $CO_2$.

The cells were then washed with Bio-Plex Cell Wash Buffer, lysed with lysing solution according to the manufacturer's directions (BioRad, Hercules, Calif.), and the cell supernatants were frozen at −20° C. To thawed cell supernatants, 1× phospho-PDGFRβ beads were added and incubated at room temperature on a shaker for 18 h. Detection antibodies were added to the washed beads and incubated at room temperature on a shaker for 30 minutes, and then streptavidin-PE was incubated with the beads at room temperature for 15 minutes. The beads were resuspended in Bio-Plex Resuspension Buffer and analyzed on a Bio-Plex array reader (Bio-Rad Laboratories).

Results

Bispecific antibodies showed potent PDGFR phosphorylation neutralization induced by PDGF-BB as shown by low nM $IC_{50}$ values in Table 46 below.

TABLE 46

Bispecific Antibodies Neutralize PDGF-BB-induced
PDGFRβ Phosphorylation in Primary Human Pericytes

| Antibody | $IC_{50}$ (nM) |
|---|---|
| E9899 (anti-PDGFRβ) | 0.14-0.17 |
| c597-c868 biAb | 0.18-0.22 |
| c597-c870 biAb | 0.15-0.24 |
| c597-c1039 biAb | 0.14-0.18 |

TABLE 46-continued

Bispecific Antibodies Neutralize PDGF-BB-induced
PDGFRβ Phosphorylation in Primary Human Pericytes

| Antibody | IC$_{50}$ (nM) |
|---|---|
| c600-c868 biAb | 0.3-0.48 |
| c600-c870 biAb | 0.2-0.3 |
| c600-c1039 biAb | 0.03-0.28 |
| c1035-c868 biscFv | 0.16-0.48 |
| c1035-c870 biscFv | 0.25-0.5 |
| c1035-c1039 biscFv | 0.16-0.61 |
| c941-c868 biscFv | 0.19-0.38 |
| c941-c1039 biscFv | 0.15 |

Example 73

Identification of Neutralizing Bispecific Antibody that Neutralizes PDGF-DD-Induced PDGFRβ Phosphorylation on Pericytes To screen for a neutralizing human PDGFRβ bispecific antibodies, a Luminex based assay was performed. The assay detects the amount of phosphorylated PDGFRβ that is present in cell lysates. Human Brain Vascular Pericytes (ScienCell Research, San Diego, Calif.) were seeded in 96 well flat bottom plates (Falcon, Colorado Springs, Colo.) at a density of 7,500 cells per well in a volume of 100 μl in complete media (ScienCell Pericyte Media (PM) plus ScienCell supplements Fetal Bovine Serum, Pericyte Growth Supplement, and Penicillin-Streptomycin) at 37° C. and 5% $CO_2$. On day two media was changed to ScienCell PM without supplements and serum starved for 24 hours. On day three media was removed from cells and serially diluted bispecific antibodies and control monoclonal antibody to human PDGFRβ (E9899) were added in assay media (ScienCell PM and 0.5% bovine serum albumin) in a volume of 50 μl and incubated for 60 minutes at 37° C. and 5% $CO_2$. PDGF-DD or PDGF-BB was added in 50 μl at 2× concentration to give a final concentration of 0.2 nM PDGF-DD and 0.44 nM PDGF-BB respectively (EC$_{80}$, effective concentration at 80 percent) and incubated for 10 minutes at 37° C. and 5% $CO_2$.

The cells were then washed with Bio-Plex Cell Wash Buffer, lysed with lysing solution according to the manufacturer's directions (BioRad, Hercules, Calif.), and the cell supernatants were frozen at −20° C. To thawed cell supernatants, 1× phospho-PDGFRβ beads were added and incubated at room temperature on a shaker for 18 h. Detection antibodies were added to the washed beads and incubated at room temperature on a shaker for 30 minutes, and then streptavidin-PE was incubated with the beads at room temperature for 15 minutes. The beads were resuspended in Bio-Plex Resuspension Buffer and analyzed on a Bio-Plex array reader (Bio-Rad Laboratories).

Results

The BiscFv c1035/c868 showed potent neutralization of PDGFRβ phosphorylation induced by PDGF-BB or PDGF-DD as shown by low nM IC$_{50}$ values in Table 47 below

TABLE 47

Neutralization of PDGF-induced Pericyte
Proliferation by PDGFRβ-specific BiscFv

| | IC$_{50}$ (nM) | |
|---|---|---|
| Antibody | PDGF-BB | PDGF-DD |
| E9899 | 0.01 | 0.02 |
| c1035.1/c868.1 | 0.05 | 0.03 |

Example 74

Luminex Assay to Determine Cross-reactivity of PDGFRβ Bispecific Antibodies to Cynomolgus PDGFRβ

To screen for cross-reactivity of bispecific antibodies to cynomolgus PDGFRβ, a Luminex based assay was performed. The assay detects the amount of phosphorylated PDGFRβ that is present in cell lysates. Cynomologus monkey skin cells (CYNOM-K1 cells), (European Collection of Cell Cultures, Wiltshire, UK) were seeded in 96 well flat bottom plates (Falcon, Colorado Springs, Colo.) at a density of 7,500 cells per well in a volume of 100 μl in complete media (Earle's MEM, 10% fetal bovine serum (FBS), 2 mM L-Glutamine, 1% non essential amino acids) for one day at 37° C. and 5% $CO_2$. On day two the cells were switched to media without FBS and serum starved for 24 hours. On day three media was removed from cells and serially diluted bispecific antibodies and control monoclonal antibody to PDGFRβ (E9899) were added in assay media (MEM plus 0.5% bovine serum albumin and 25 mM HEPES) in a volume of 50 μl and incubated for 60 minutes at 37° C. and 5% $CO_2$. PDGF-BB was added in 50 μl at 2× concentration to give a final concentration of. 0.33 nM (EC$_{80}$, effective concentration at 80 percent) and incubated for 10 minutes at 37° C. and 5% $CO_2$.

The cells were then washed with Bio-Plex Cell Wash Buffer, lysed with lysing solution according to the manufacturer's directions (BioRad, Hercules, Calif.), and the cell supernatants were frozen at −20° C. To thawed cell supernatants, 1× phospho-PDGFRβ beads were added and incubated at room temperature on a shaker for 18 h. Detection antibodies were added to the washed beads and incubated at room temperature on a shaker for 30 minutes, and then streptavidin-PE was incubated with the beads at room temperature for 15 minutes. The beads were resuspended in Bio-Plex Resuspension Buffer and analyzed on a Bio-Plex array reader (Bio-Rad Laboratories):

Results

Bispecific antibodies showed potent PDGFRβ phosphorylation neutralization induced by PDGF-BB as shown by low nM IC$_{50}$ values in Table 48 below.

TABLE 48

Bispecific Antibodies Neutralize PDGF-BB-induced
PDGFRβ Phosphorylation in Cynomolgus Cells

| Antibody | IC$_{50}$ (nM) |
|---|---|
| E9899 (anti-PDGFRβ) | NA |
| c597-c868 biAb | 0.13 |
| c597-c870 biAb | 0.16 |
| c597-c1039 biAb | 0.09 |
| c600-c868 biAb | 0.29 |
| c600-c870 biAb | 0.32 |

TABLE 48-continued

Bispecific Antibodies Neutralize PDGF-BB-induced
PDGFRβ Phosphorylation in Cynomolgus Cells

| Antibody | IC$_{50}$ (nM) |
| --- | --- |
| c600-c1039 biAb | 0.22 |
| c1035-c868 biscFv | 0.11 |
| c1035-c870 biscFv | 0.14 |
| c1035-c1039 biscFv | 0.1 |
| c941-c868 biscFv | 0.03 |
| c941-c1039 biscFv | 0.03 |

NA—no activity detected

Example 75

Inhibition of Endothelial and Pericyte Growth and Morphogenesis by the PDGFRβ/VEGF-A Antagonist in an In Vitro Co-culture Sprouting Assay Summary To test efficacy of the PDGFRβ/VEGF-A bispecific antagonist, an in vitro co-culture system of endothelial cells and pericytes were established. In this co-culture, HUVECs coated on Cytodex beads are imbedded in fibrin gel together with human mesenchymal stem cells. The cells are grown in EGM-2 complete media conditioned by D551 human fibroblast. Either at start of the experiment (prophylactic setting) or on Day 8 of the experiment (therapeutic setting), control antagonist, PDGFRβ antagonist (anti-PDGFRβ antibody E9899), VEGF-A antagonist (Bevacizumab, Genentech) or PDGFRβ/VEGF-A bispecific antagonist of indicated concentration was added to the culture. Cultures were fixed 7 days after the addition of antagonists with PFA. Endothelial cells and pericytes were stained with anti-PECAM and anti-a-smooth muscle actin (αSMA) antibodies, respectively. In control wells, cells formed sprouts of endothelial cells protected by a covering of pericytes. Addition of VEGF-A antagonist resulted in reduced number and length of endothelial sprouts, whereas PDGFRβ antagonist had no effect on sprout length and number, but led to the dissociation of pericytes from the sprouts. The PDGFRβ/VEGF-A bispecific antagonist led to the dissociation of pericytes from endothelial sprouts as well as a reduced number and length of endothelial sprouts. The reduction in number and length of endothelial sprouts with PDGFRβ/VEGF-A bispecific antagonists was significantly greater than with VEGF-A antagonist alone.

Study Design

On Day 1, Cytodex-3 beads (GE healthcare) were coated with HUVECs (Lonza) at a ratio of 400 cells per bead and incubated overnight at 37° C., 5% CO$_2$. On Day 2, HUVEC beads (100 beads/well) were embedded in fibrin gel along with human mesenchymal stem cells (hMSC, Lonza, 30,000 cells/well) in wells of a 24-well tissue culture plate. A 1:1 mixture of fresh EGM-2 complete media (Lonza) and D551 fibroblast conditioned EGM-2 media were added to these cells along with 2 ng/mL of recombinant human HGF. Medium is replaced every two days till the end of the experiment. Antagonists were added to the culture on Day 2 (from start of the co-culture, prophylactic setting) or on Day 8 (after EC sprouts and pericyte covering are formed, therapeutic setting). 7 days after addition of antagonists, cells were fixed in 4% PFA overnight at 4° C. Cells were stained with anti-PECAM or anti-SMA antibodies followed by secondary antibody (fluorescent conjugated). Cells were then viewed by an inverted fluorescence microscope and 6× images were captured. A representative set of 10 beads/well for each condition were chosen randomly. The total length of all the sprouts around a bead was measured in MetaMorph (version 7.1.6.0) by utilizing the angiogenesis tube formation application. Parameters were as follows: approximate min width 1 pixel, approximate max width 40 pixels, intensity above local background: 40 graylevels (prophylactic setting) or 100 graylevels (therapeutic setting).

Results

Figure 4A:
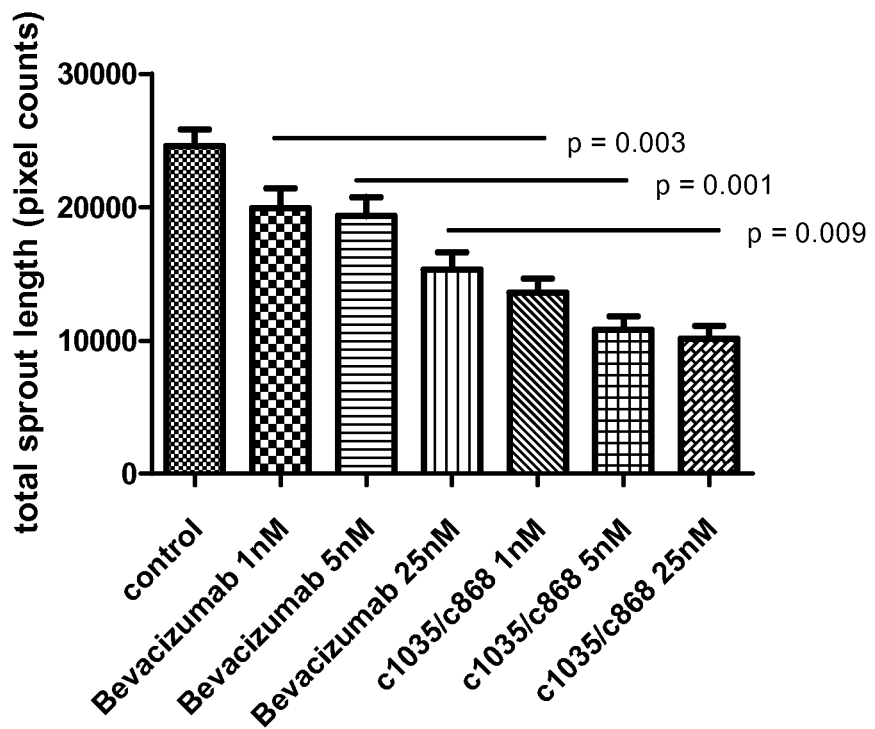
FIGS. 4A-4D depict inhibition of endothelial cell sprouting by PDGFRβ/VEGF-A bispecific antagonists in an in vitro co-culture sprouting assay in a therapeutic setting. Cytodex-3 beads coated with HUVECs were embedded in fibrin gel along with human mesenchymal stem cells and cultured with EGM-2 complete media and D551 fibroblast conditioned media (1:1) with recombinant human HGF. (See Example 75.) Antagonists—anti-VEGF-A (Bevacizumab, Genentech) or a PDGFRβ/VEGF-A bispecific antibody (c1035/c868 biscFv (4A), c1035/c1039 biscFv (4B), c597/c1039 biAb (4C), or c600/c1039 biAb (4D))—were added to the culture on Day 8 (after EC sprouts and pericyte covering are formed) at the indicated concentrations. 7 days after addition of antagonists, cells were fixed and stained with anti-PECAM or anti-SMA antibodies followed by secondary antibody. Cells were then viewed by an inverted fluorescence microscope and analyzed for endothelial cell sprout length as described in Example 75.
Figure 4B:
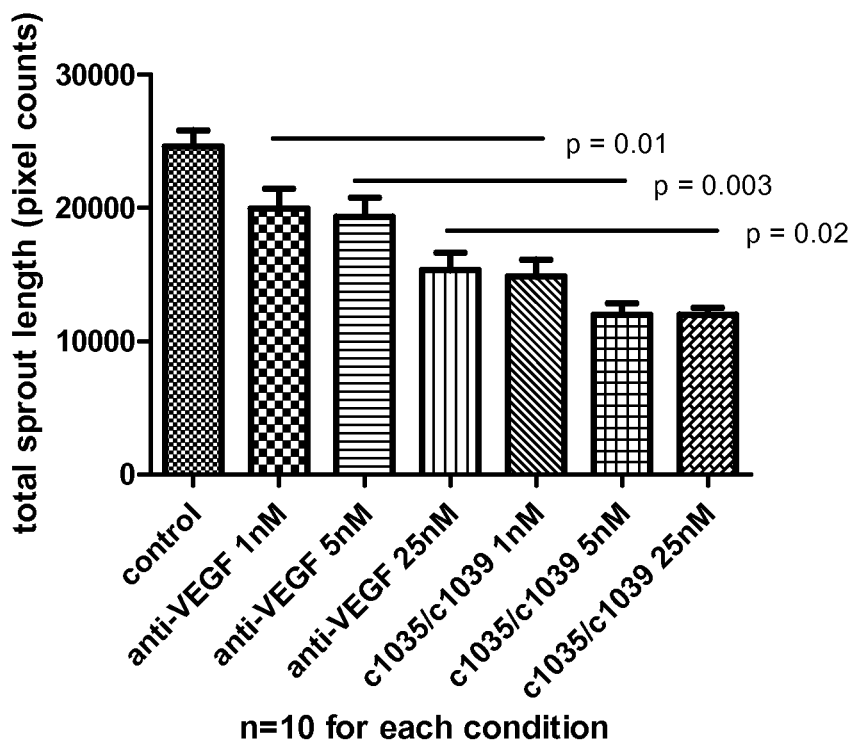
Figure 4C:
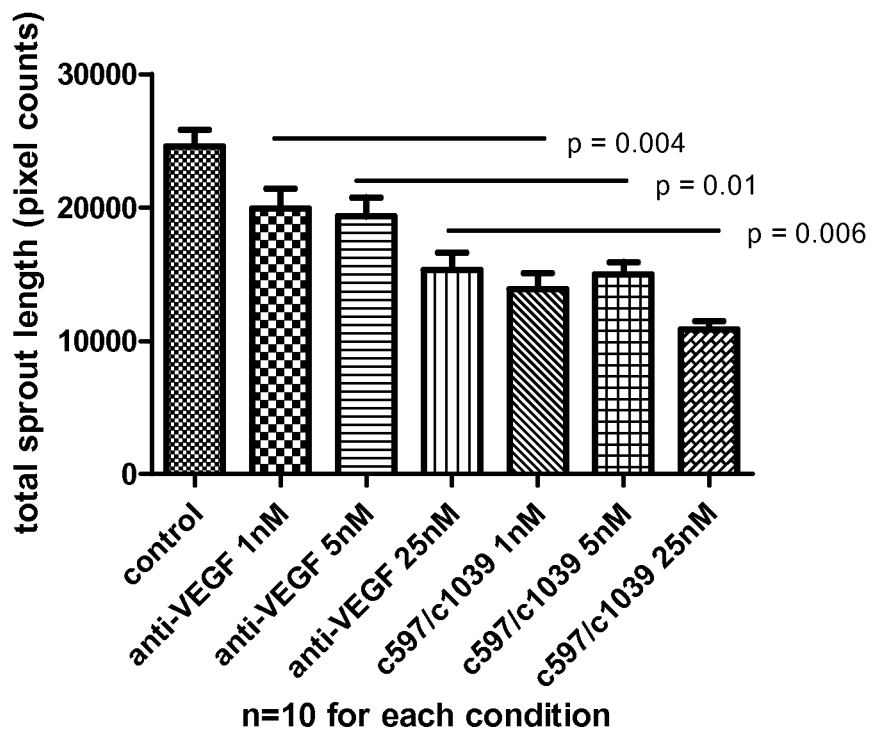
Figure 4D:
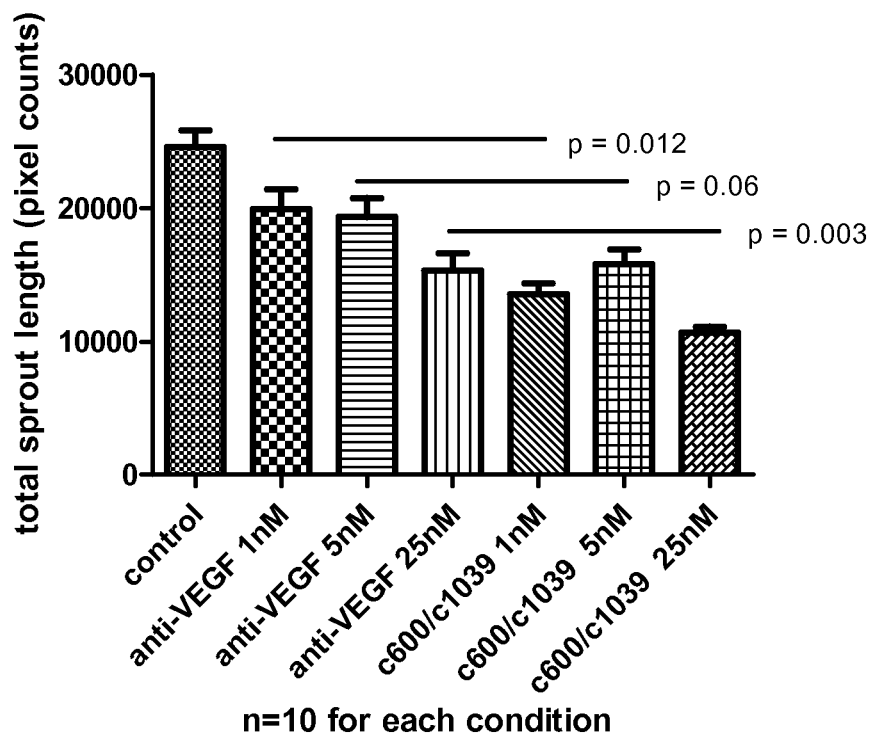

The effect of PDGFRβ/VEGF-A bispecific antagonists on endothelial sprouts are summarized in FIGS. 3 and 4A-4D. In wells with control antagonist treatment, cells formed sprouts of endothelial cells protected by a covering of pericytes. In the prophylactic setting, VEGF-A antagonist alone, PDGFRβ/VEGF-A bispecific molecules (c1035/c868 biscFv, c1035/c1039 biscFv, c597/c1039 biAb, and c600/c1039 biAb), and the combination of VEGF-A and PDGFRβ antagonists each inhibited endothelial sprouts compared to control. (See FIG. 3.) Inhibition of endothelial sprouts with PDGFRβ/VEGF-A bispecific molecules or the combination of VEGF-A and PDGFRβ, antagonists was significantly greater than with VEGF-A antagonist alone. (See id.)

In the therapeutic setting, VEGF-A antagonist alone and each of the PDGFRβ/VEGF-A bispecific molecules—c1035/c868 biscFv (FIG. 4A), c1035/c1039 biscFv (FIG. 4B), c597/c1039 biAb (FIG. 4C), and c600/c1039 biAb (FIG. 4D)—inhibited endothelial sprouting compared to control. (The combination of VEGF-A and PDGFRβ antagonist was not tested in the therapeutic setting.) Inhibition of endothelial sprouts with PDGFRβ/VEGF-A bispecific molecules was significantly greater than with VEGF-A antagonist alone. (See FIGS. 4A-4D.)

Example 76

Immunofluorescence-based Internalization Assay for Measuring the Effect of PDGFRβ/VEGFA Antagonists on Receptor Internalization Summary Antibodies and antibody-like molecules, when bound to cell-surface receptor, could mediate internalization of the receptor. PDGF-BB induces activation and internalization of the PDGFRβ. Similarly, antibodies to PDGFRβ have been shown to mediate internalization and this process contributes partially to the antagonist activity of the antibody. The ability of two PDGFRβ/VEGF-A bispecific antibodies—c1035/c1039 biscFv and c1035/c868 biscFv—to be internalized when bound to primary human pericytes was tested. Whether pre-bound human VEGF-A to one arm of the bispecific antibody would inhibit internalization mediated by the antagonist was also tested.

Material and Methods

Low passage Human Brain Vascular Pericytes (HBVP) (ScienCell Research, San Diego, Calif.) were plated at sub-confluency on 4 chamber glass Lab-TekII chamber slides (catalog #154917 Nalge Nunc, Naperville, Ill.) at volume of 500 μl/chamber in complete media (ScienCell Pericyte Media (PM) plus ScienCell supplements Fetal Bovine Serum, Pericyte Growth Supplement, and Penicillin-Streptomycin). Chamber slides were incubated at 37° C. and 5% CO$_2$ for 1-2 days until they reach approximately 75% confluency. The binding of PDGFRβ/VEGFA antibodies and control antibody were done at 4° C., so all slides are placed on ice and washed one time with cold DMEM+0.1% BSA. The PDGFRβ/VEGFA antibodies and test antibody were then diluted to 1 mg/ml in binding buffer consisting of DMEM+3% BSA and Hepes buffer. Each slide is configured so that two antibodies, one control antibody and one control well for secondary antibody only are designated for each chamber slide. 500 µl/well of antagonists, control, or media only is added to each chamber slide. Following a one hour incubation, the T0 slide was fixed by washing with cold PBS one time and adding 1 ml/well paraformaldehyde solution. This T0 slide measures receptor expression on the cell surface and the slides incubated at 37° C. measure receptor internalization over time. The remaining slides were put in the 37° C. incubator and removed and fixed in a similar fashion at thirty minutes, ninety minutes, four hour, and six hour time points. All slides were kept on ice after fixation. Once all of the slides were fixed, they were washed one time with PBS and permeabilized for two minutes with −20° C. MetOH. The slides were washed again with cold PBS. From this point forward, the staining was done at room temperature. The slides were incubated at room temperature for five minutes in 50 mM Glycine made up in PBS. The glycine was removed and washed off with PBS, and the slides were blocked in 10% normal goat serum in PBS (#S-1000, Vector Labs, Inc. Burlingame, Calif.), 500 µl/well for thirty minutes. Following the blocking step, 500 µl/well of the secondary antibodies was added to every well. Alexafluor 488 goat anti-mouse (Cat. # A11029, Molecular Probes, Eugene, Oreg.), or Alexafluor 488 goat anti-human (Cat. # A11013, Molecular Probes, Eugene, Oreg.) was diluted 1:150 in wash buffer consisting of PBS+0.1% Tween 20 and 0.1% BSA. The slides were incubated in the dark at room temperature for forty-five minutes. Each slide was washed three times by soaking in PBS for 5 minutes at room temperature. One drop of Vectashield mounting medium with DAPI stain was added to each chamber (Cat. # H-1200, Vector Labs, Inc., Burlingame Calif.), and the slides were cover-slipped and examined under the fluorescent microscope. Metavue software was used to visualize the two-color staining profile.

In some experiments, the PDGFRβ/VEGF-A bispecific antibodies were preincubated with 5 nM human VEGF-A before addition to the cells. Internalization was followed as described above.

Results

The c1035/c1039 and c1035/c868 bispecific antibodies were internalized efficiently as seen by the punctate staining inside the cells after incubation at 37° C. Preincubation with VEGF-A did not affect internalization of these bispecific molecules.

Example 77

FcRn Binding Assay for Measuring Binding of PDGFRβ/VEGF-A Antagonists to FcRn at pH 6.0 and pH 7.4

Summary

FcRn (neonatal receptor) is a key receptor that binds to the Fc-region of IgG. This binding induces internalization into the cells and these IgGs are then "recycled" into circulation. This is the key reason why IgGs have long half-life in serum. The ability of PDGFRβ/VEGF-A bispecific antibodies to bind FcRn in vitro at pH6.0 and release at pH7.4, as is seen in a physiological setting, was tested.

Materials and Methods

Two plates were set up with PDGFRβ/VEGFA antibodies and control antibodies: one to wash at pH 6.0 and one to wash at pH 7.4. Day 1: Two Nunc Maxisorp 96 well elisa plates (cat. #44-2404) were coated with 300 ng/well NeutrAvidin (Pierce Chemical Co. cat. #31000) made up in 100 mM NaHCO$_3$, pH 9.3. Plates were incubated at 4° C. overnight. Day 2: The plates were washed 5 times with 0.1% Tween-20/PBS (PBST). The plates were then blocked with 250 µl/well of blocking buffer containing 0.8% NaCl, 0.02% KCl, 0.102% Na$_2$HPO$_4$, 0.02% KH$_2$PO$_4$, 1% BSA, 0.05% Polysorbate, 0.05% Proclin 300 pH 7.2, for one hour at room temperature. The plates were then washed 2 times with PBST. Each well was then coated with 150 ng of biotinylated single chain FcRn (scFcRn) protein (amino acid residue 21-409 of SEQ ID NO:644) diluted in PBST+1% BSA. Plates were incubated at room temperature for one hour. PDGFRβ/VEGFA antibodies and control antibodies (Herceptin, for example) were diluted in 100 mM NaPO$_4$, 0.05% Tween 20 (v/v), +0.1% BSA adjusted to pH 6.0 (pH 6.0 buffer) at concentrations ranging from 150 nM to 0.07 nM. Samples were tested in duplicate at a volume of 50 Owen of each concentration. pH 6.0 buffer only was run as a control to determine the background levels on each plate. Plates were incubated at room temperature for two hours. After the binding step, each plate was washed in separate buffers: one plate was washed with 250 µl/well of pH 6.0 buffer, and one plate was washed with 250 µl/well of 100 mM NaPO$_4$, 0.05% Tween 20 (v/v), 0.1% BSA adjusted to pH 7.4 (pH 7.4 buffer). Plates were incubated in wash buffers at room temperature for a total of one hour with a wash step performed every twenty minutes. Following the wash steps, the bound antibody was detected with 100 µl/well of HRP goat anti-human IgG F(ab)$_2$ fragment Fc gamma specific secondary antibody (Jackson Immunoresearch Cat. #109-036-098). The secondary antibody was diluted 1:5,000 in the pH 6.0 buffer, and the incubation is done for one hour at room temperature. Plates were then washed 5 times with PBST. Finally, 100 µl of TMB (TMBW-1000-01, BioFX Laboratories) was added to each well, and the plates were developed at room temperature for approximately three minutes. At this point, 100 µl/well of stop buffer (STPR-100-01, BioFX Laboratories) was added to quench the reaction. The plates were read on a spectrophotometer at a wave length of 450/570 nm. OD values were examined to compare binding patterns at pH 6.0 and release patterns at pH 7.4.

Results

All the bispecific molecules tested (c1035/c1039 biscFv, c1035/c868 biscFv, c1035/c870 biscFv, c597/c1039 biAb, c597/c868 biAb, c597/c870 biAb, c600/c1039 biAb, c600/c870 biAb, c600/c868 biAb) bound FcRn well at pH6.0 and showed less binding (release) at pH7.4. The curves obtained were similar to that seen with the anti-VEGF-A antibody bevacizumab (Avastin®). These data show that the bispecific molecules bind to FcRn as expected for IgG-containing proteins and would be expected to have good half-lives in serum.

Example 78

Inhibition of Human Glioblatoma Cells In Vivo Using Anti-PDGFRβ/Anti-VEGF-A Bispecific Antibody To evaluate anti-tumor activity of an anti-PDGFRβ/anti-VEGF-A bispecific antibody against human glioblastoma cells in vivo, groups of BALB/c nude mice or C.B-17 SCID are injected with either U118, U251 or U87-MG glioblastoma cells on Day 0. Groups (n=10/group) of tumor bearing mice receive 5-75 µg human anti-PDGFRβ/anti-VEGF-A bispecific antibody by i.p. or peritumoral injection every other day (EOD) from Days 5-33. Tumor volume is monitored 3x/week for 6 weeks. Inhibition of tumor growth (volume or weight) by anti-PDGFRβ/anti-VEGF-A bispecific antibody suggests that the respective protein has inhibitory effects on human glioblastoma cells in vivo.

Study design: Eight-week old female BALB/c nude or C.B-17 SCID mice (Charles River Laboratories) are injected s.c. on the right flank or orthotopically into the cranial wall with 6×106 U118, U251 or U87-MG cells on Day 0. Groups of mice (n=10/group) are injected i.p. or peritumorally (for s.c model only) with 5-75 μg human an anti-PDGFRβ/anti-VEGF-A bispecific antibody from days 5-33 or when tumors reach a volume of 200 mm$^3$. Injections are given in a total volume of 200 μl. For s.c tumors, tumor growth is monitored 3x/week for 6 weeks using caliper measurements. Tumor volume is calculated using the formula ½*(B)2*L (mm$^3$). For orthotopic tumors, mice are terminated at the end of the study and tumor weighed to enable tumor load assessment.

Example 79

Prophylactic Treatment with PDGFRβ/VEGF-A Bispecific Antibodies Inhibits Growth of A673 Rhabdomyosarcoma Cells in SCID Mice Summary To test if the PDGFRβ/VEGF-A bispecific antagonist has activity on tumor growth in mice, groups of mice were injected s.c with the A673 rhabdomyosarcoma tumor on Day 0. Groups of mice (n=10/gp) mice were then injected with 0.01 mg/Kg to 10 mg/Kg control reagent, VEGF-A antagonist, PDGFRβ antagonist or PDGFRβ/VEGF-A antagonist 2x/week for 4 weeks, starting one day after tumor inoculation. Tumor volume was monitored 3x/week for 4 weeks. Significantly smaller tumors in mice injected with a VEGF-A antagonist, or PDGFRβ/VEGF-A antagonist, as compared to mice injected with control reagent, indicated efficacy of the antagonist for inhibition of tumor growth. Because the anti-PDGFRβ arm of each tested PDGFRβ/VEGF-A antagonist does not cross-react with murine PDGFRβ, this model only tests for VEGF-targeted efficacy.

Study Design

Eight to ten-week old female C.B-17 SCID mice (Charles River Laboratories) were injected s.c. on the right flank with 2×10$^6$ A673 cells on Day 0, Starting on Day 1, groups of mice (n=10/group) were injected i.p. with concentrations between 0.01 mg/Kg to 10 mg/Kg control reagent, VEGF-A antagonist, PDGFRβ antagonist, or PDGFRβ/VEGF-A antagonist 2x/week for 4 weeks. Tumor growth was monitored 3x/week for 4 weeks using caliper measurements. Tumor volume was calculated using the formula ½*(B)2*L (mm$^3$). At the end of the study (24 hrs after last dose), mice were terminated and tumors weighed and submitted for histology. Tumors were fixed in NBF and were then tested for blood vessel density by immunohistochemistry using the MECA-32 antibody that is specific for mouse endothelial cells.

Results

As shown below in Tables 49-51 below, bispecific antibodies at varying doses significantly inhibited tumor growth compared to vehicle-treated mice. Efficacy seen with the bispecific antibodies was comparable to that seen with bevacizumab (VEGF-antagonist).

TABLE 49

Inhibition of A673 Rhabdomyosarcoma Cell Growth in SCID Mice by Prophylactic Treatment with PDGFRβ/VEGF-A Bispecific Antibodies (Experiment 1)

| Group | Tumor volume* (mm$^3$) | STDEV | p-value† |
|---|---|---|---|
| Vehicle | 1854.34 | 395.416 | NA |
| anti-human PDGFRβ | 1481.55 | 667.331 | ns |
| 10 mg/kg bevacizumab | 235.796 | 156.302 | p < 0.0001 |
| 1 mg/kg bevacizumab | 317.491 | 140.164 | p < 0.0001 |
| 0.25 mg/kg bevacizumab | 366.067 | 332.667 | p < 0.0001 |
| 10 mg/kg c597/c1039 biAb | 105.488 | 47.4274 | p < 0.0001 |
| 1 mg/kg c597/c1039 biAb | 338.714 | 263.772 | p < 0.0001 |
| 0.25 mg/kg c597/c1039 biAb | 541.033 | 222.8 | p < 0.0001 |
| 10 mg/kg c1035/c1039 biscFv | 142.116 | 44.3071 | p < 0.0001 |
| 1 mg/kg c1035/c1039 biscFv | 214.489 | 253.271 | p < 0.0001 |
| 0.25 mg/kg c1035/c1039 biscFv | 709.549 | 410.836 | p < 0.001 |

*Tumor volume shown is at termination (Day 25, 24 hrs after last dose)
†p-value compared to vehicle controls

TABLE 50

Inhibition of A673 Rhabdomyosarcoma Cell Growth in SCID Mice by Prophylactic Treatment with PDGFRβ/VEGF-A Bispecific Antibodies (Experiment 2)

| Group | Tumor volume (mm$^3$)* | STDEV | p-value† |
|---|---|---|---|
| Vehicle | 1404.93 | 852.953 | NA |
| 10 mg/kg Bevacizumab | 127.673 | 76.2626 | p < 0.0001 |
| 1 mg/kg Bevacizumab | 136.778 | 112.317 | p < 0.0001 |
| 0.25 mg/kg Bevacizumab | 260.484 | 233.558 | p < 0.0001 |
| 10 mg/kg c600/c1039 biAb | 102.988 | 89.5476 | p < 0.0001 |
| 1 mg/kg c600/c1039 biAb | 99.1523 | 98.8491 | p < 0.0001 |
| 0.25 mg/kg c600/c1039 biAb | 206.719 | 229.873 | p < 0.0001 |
| 10 mg/kg c1039/c868 biscFv | 165.217 | 78.6582 | p < 0.0001 |
| 1 mg/kg c1039/c868 biscFv | 239.939 | 226.698 | p < 0.0001 |
| 0.25 mg/kg c1039/c868 biscFv | 466.38 | 528.251 | p < 0.0001 |

*Tumor volume shown is at termination (Day 30, 24 hrs after last dose)
†p-value compared to vehicle controls

TABLE 51

Inhibition of A673 Rhabdomyosarcoma Cell Growth in SCID Mice by Prophylactic Treatment with PDGFRβ/VEGF-A Bispecific Antibodies (Experiment 3)

| Group | Tumor volume (mm$^3$) | | Tumor weight (g) | |
|---|---|---|---|---|
| | Average | STDEV | Average | STDEV |
| Vehicle | 1310 | 676 | 1.392 | 0.87 |
| 1 mg/kg bevacizumab | 416 | 244 | 0.358 | 0.12 |
| 0.1 mg/kg bevacizumab | 921 | 478 | 0.933 | 0.50 |
| 0.01 mg/kg bevacizumab | 1237 | 777 | 1.523 | 0.89 |
| 1 mg/kg c1035/c868 biscFv | 320 | 175 | 0.327 | 0.24 |
| 0.1 mg/kg c1035/c868 biscFv | 893 | 752 | 0.942 | 0.96 |
| 0.01 mg/kg c1035/c868 biscFv | 1462 | 713 | 1.645 | 0.73 |
| 1 mg/kg c1035/c1039 biscFv | 311 | 140 | 0.226 | 0.08 |
| 0.1 mg/kg c1035/c1039 biscFv | 505 | 431 | 0.496 | 0.40 |
| 0.01 mg/kg c1035/c1039 biscFv | 1427 | 753 | 1.618 | 0.84 |

Example 80

Therapeutic Treatment with PDGFRβ/VEGF-A Bispecific Antibodies Inhibits Growth of A673 Rhabdomyosarcoma Cells in SCID Mice Summary To test if the PDGFRβ/VEGF-A bispecific antagonist has activity on tumor growth in mice, groups of mice were injected s.c with the A673 rhabdomyosarcoma tumor on Day 0. When tumors reached a size of 200 mm$^3$, groups of mice (n=10/gp) mice were then injected with 5 mg/Kg control reagent, VEGF-A antagonist, or PDGFRβ/VEGF-A antagonist 2x/week for a total of 5 doses. Tumor volume was monitored 3x/week. Significantly smaller tumors in mice injected with a VEGF-A antagonist, or PDGFRβ/VEGF-A antagonist, as compared to mice injected with control reagent, indicated efficacy of the antagonist for inhibition of tumor growth. Because the anti-PDGFRβ arm of each tested PDGFRβ/VEGF-A antagonist does not cross-react with murine PDGFRβ, this model only tests for VEGF-targeted efficacy.

Study Design

Eight to ten-week old female C.B-17 SCID mice (Charles River Laboratories) were injected s.c. on the right flank with 2×10$^6$ A673 cells on Day 0. When tumors reached a size of 200 mm$^3$, groups of mice (n=10/group) were injected i.p. with 5 mg/Kg control reagent, VEGF-A antagonist, or PDGFRβ/VEGF-A antagonist 2x/week for 5 doses. Tumor growth was monitored 3x/week using caliper measurements. Tumor volume was calculated using the formula 1/2*(B)2*L (mm$^3$). At the end of the study (24 hrs after last dose), mice were terminated and tumors weighed.

Results

As shown below in Table 52, bispecific antibodies significantly inhibited tumor growth compared to vehicle treated mice. Efficacy seen with the bispecific antibodies was comparable to that seen with bevacizumab (VEGF-antagonist) at the same dose.

TABLE 52

Inhibition of A673 Rhabdomyosarcoma Cell Growth in SCID Mice by Therapeutic Treatment with PDGFRβ/VEGF-A Bispecific Antibodies

| Group | Volume (mm$^3$)* | STDEV | p-vlaue† |
|---|---|---|---|
| Vehicle | 1014 | 341.89 | NA |
| 5 mg/Kg bevacizumab | 343 | 59.23 | p < 0.001 |
| 5 mg/Kg c1035/c868 biscFv | 359 | 122.34 | p < 0.001 |
| 5 mg/Kg c1035/c1039 biscFv | 292 | 133.73 | p < 0.001 |

*Volume is shown is at 24 hrs after 5th dose of treatment
†p-value compared to controls

Example 81

Luminex Assay to Determine Neutralizing Activity of PDGFRβ/VEGF-A Bispecific Antibodies Against PDGFRβ Phosphorylation Induced by PDGF Ligands To screen for a neutralizing activity of bispecific antibodies against various PDGF ligands, a Luminex based assay was performed after PDGF-stimulation of BHK cells transected with human PDGFRβ (BHK 570 E10.2 B3, see Examples 20 and 21). The assay detects the amount of phosphorylated PDGFRβ that is present in cell lysates. Human PDGFRβ-transfected BHK 570 E10.2 B3 cells were seeded in 96 well flat bottom plates (Falcon, Colorado Springs, Colo.) at a density of 7,500 cells per well in a volume of 100 μl in complete media at 37° C. and 5% $CO_2$. The next day, media was removed from cells and serially diluted bispecific molecules (BiscFv and BiAb) and control monoclonal antibody to PDGFRβ (E9899) were added in serum-free assay media in a volume of 50 μl and incubated for 60 minutes at 37° C. and 5% $CO_2$. Human PDGF-BB (0.2 nM, $EC_{80}$, 80% effective concentration), human PDGF-AB (3 nM, $EC_{80}$, R&D systems), human PDGF-CC (1 nM, $EC_{80}$) or human PDGF-DD (0.2 nM, $ED_{80}$) were added to cells in a volume of 50 μL and incubated for 10 minutes at 37° C. and 5% $CO_2$.

The cells were then washed with Bio-Plex Cell Wash Buffer, lysed with lysing solution according to the manufacturer's directions (BioRad, Hercules, Calif.), and the cell supernatants were frozen at −20° C. To thawed cell supernatants, 1× phospho-PDGFRB beads were added and incubated at room temperature on a shaker for 18 h. Detection antibodies were added to the washed beads and incubated at room temperature on a shaker for 30 minutes, and then streptavidin-PE was incubated with the beads at room temperature for 15 minutes. The beads were resuspended in Bio-Plex Resuspension Buffer and analyzed on a Bio-Plex array reader (Bio-Rad Laboratories).

Results

BiscFvs and BiAbs showed potent PDGFR phosphorylation neutralization induced by various PDGF ligands as shown by low nM $IC_{50}$ values in the tables below. These data suggest that the BiscFvs and BiAbs neutralize activity mediated through PDGFRβ/β homodimer and also due to PDGFRα/β heterodimer as these BHK cells express residual levels of bovine PDGFRα.

TABLE 53

Neutralization of PDGF-ligand-induced PDGFRβ phsophorylation by BiscFvs and BiAbs (IC50 - nM)

| Molecules | PDGF-AB | PDGF-BB | PDGF-CC | PDGF-DD |
|---|---|---|---|---|
| E9899 | 0.2 | 0.1 | 0.2 | 0.05 |
| c1035/c1039 | 0.1 | 0.2 | 0.1 | 0.01 |
| c1035/c868 | 0.2 | 0.3 | 0.2 | 0.003 |
| c597/c1039 | 0.1 | 0.2 | 0.2 | 0.007 |
| c600/c1039 | 0.2 | 0.6 | 0.2 | 0.2 |

From the foregoing, it will be appreciated that, although specific embodiments of the invention have been described herein for purposes of illustration, various modifications may be made without deviating from the spirit and scope of the invention. Accordingly, the invention is not limited except as by the appended claims. All publications, patents, and patent applications cited herein are hereby incorporated by reference in their entireties for all purposes.

SEQUENCE LISTING (650 sequences)

SEQ ID NO: 1 - DNA, 576 bp, Homo sapien
atgaactttctgctgtcttgggtgcattggagcctcgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtga

SEQ ID NO: 2 - protein, 191 aa, Homo sapien
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRCDKPRR

SEQ ID NO: 3 - DNA, 3321 bp, Homo sapien
atgcggcttccgggtgcgatgccagctctggccctcaaaggcgagctgctgttgctgtctctcctgttacttctggaaccacagatctctcagggcctggtcgtcacacccccggggccagagcttgtcctcaatgtctccagcaccttcgttctgacctgctcgggttcagctccggtggtgtgggaacggatgtcccaggagcccccacaggaaatggccaaggcccaggatggcaccttctccagcgtgctcacactgaccaacctcactgggctagacacgggagaatacttttgcacccacaatgactcccgtggactggagaccgatgagcggaaacggctctacatctttgtgccagatcccaccgtgggcttcctccctaatgatgccgaggaactattcatctttctcacggaaataactgagatcaccattccatgccgagtaacagacccacagctggtggtgacactgcacgagaagaaaggggacgttgcactgcctgtcccctatgatcaccaacgtggcttttctggtatctttgaggacagaagctacatctgcaaaaccaccattggggacagggaggtggattctgatgcctactatgtctacagactccaggtgtcatccatcaacgtctctgtgaacgcagtgcagactgtggtccgccagggtgagaacatcaccctcatgtgcattgtgatcgggaatgaggtggtcaacttcgagtggacatacccccgcaaagaaagtgggcggctggtggagccggtgactgacttcctcttggatatgccttaccacatccgctccatcctgcacatccccagtgccgagttagaagactcggggacctacacctgcaatgtgacggagagtgtgaatgaccatcaggatgaaaaggccatcaacatcaccgtggttgagagcggctacgtgcggctcctgggagaggtgggcacactacaatttgctgagctgcatcggagccggacactgcaggtagtgttcgaggcctacccaccgcccactgtcctgtggttcaaagacaaccgcaccctgggcgactccagcgctggcgaaatcgccctgtccacgcgcaacgtgtcggagacccggtatgtgtcagagctgacactggttcgcgtgaaggtggcagaggctggccactacaccatgcgggccttccatgaggatgctgaggtccagctctccttccagctacagatcaatgtccctgtccgagtgctggagctaagtgagagccaccctgacagtggggaacagacagtccgctgtcgtggccggggcatgccccagccgaacatcatctggtctgcctgcagagacctcaaaaggtgtccacgtgagctgccgcccacgctgctggggaacagttccgaagaggagagccagctggagactaacgtgacgtactgggaggaggagcaggagtttgaggtggtgagcacactgcgtctgcagcacgtggatcggccactgtcggtgcgctgcacgctgcgcaacgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgttacgagatccgatggaaggtgattgagtctgtgagctctgacggccatgagtacatctacgtggaccccatgcagctgccctatgactccacgtgggagctgccgcgggaccagcttgtgctgggacgcaccctcggctctggggcctttgggcaggtggtggaggccacggctcatggcctgagccattctcaggccacgatgaaagtggccgtcaagatgcttaaatccacagcccgcagcagtgagaagcaagcccttatgtcggagctgaagatcatgagtcaccttgggccccacctgaacgtggtcaacctgttgggggcctgcaccaaaggaggacccatctatatcatcactgagtactgccgctacggagacctggtggactacctgcaccgcaacaaacacaccttcctgcagcaccactccgacaagcgccgcccgcccagcgcggagctctacagcaatgctctgcccgttgggctccccctgcccagccatgtgtccttgaccggggagagcgacggtggctacatggacatgagcaaggacgagtcggtggactatgtgcccatgctggacatgaaaggagacgtcaaatatgcagacatcgagtcctccaactacatggccccttacgataactacgttccctctgcccctgagaggacctgccgagcaactttgatcaacgagtctccagtgctaagctacatggacctcgtgggcttcagctaccaggtggccaatggcatggagtttctggcctccaagaactgcgtccacagagacctggcggctaggaacgtgctcatctgtgaaggcaagctggtcaagatctgtgactttggcctggctcgagacatcatgcgggactcgaattacatctccaaaggcagcacctttttgcctttaaagtggatggctccggagagcatcttcaacagcctctacaccaccctgagcgacgtgtggtccttcgggatcctgctctgggagatcttcaccttgggtggcaccccttacccagagctgcccatgaacgagcagttctacaatgccatcaaacggggttaccgcatggcccagcctgcccatgcctccgacgagatctatgagatcatgcagaagtgctgggaagagaagtttgagattcggccccccttctcccagctggtgctgcttctcgagagactgttgggcgaaggttacaaaaagaagtaccagcaggtggatgaggagtttctgaggagtgaccacccagccatccttcggtcccaggcccgcttgcctgggttccatggcctccgatctcccctggacaccagctccgtcctctatactgccgtgcagcccaatgagggtgacaacgactatatcatccccctgcctgaccccaaacccgaggttgctgacgagggcccactggagggttcccccagcctagccagctccaccctgaatgaagtcaacacctcctcaaccatctcctgtgacagccccctggagccccaggacgaaccagagccagagccccagcttgagctccaggtggagccggagccagagctggaacagttgccggattcggggtgccctgcgcctcgggcggaagcagaggatagcttcctgtag

SEQ ID NO: 4 - protein, 1106 aa, Homo sapien
MRLPGAMPALALKGELLLLSLLLLLEPQISQGLVVTPPGPELVLNVSSTFVLTCSGSAPVVWERMSQEPPQEMAKAQDGTFSSVLTLTNLTGLDTGEYFCTHNDSRGLETDERKRLYIFVPDPTVGFLPNDAEELFIFLTEITEITIPCRVTDPQLVVTLHEKKGDVALPVPYDHQRGFSGIFEDRSYICKTTIGDREVDSDAYYVYRLQVSSINVSVNAVQTVVRQGENITLMCIVIGNEVVNFEWTYPRKESGRLVEPVTDFLLDMPYHIRSILHIPSAELEDSGTYTCNVTESVNDHQDEKAINITVVESGYVRLLGEVGTLQFAELHRSRTLQVVFEAYPPPTVLWFKDNRTLGDSSAGEIALSTRNVSETRYVSELTLVRVKVAEAGHYTMRAFHEDAEVQLSFQLQINVPVRVLELSESHPDSGEQTVRCRGRGMPQPNIIWSACRDLKRCPRELPPTLLGNSSEEESQLETNVTYWEEEQEFEVVSTLRLQHVDRPLSVRCTLRNAVGQDTQEVIVVPHSLPFKVVVISAILALVVLTIISLIILIMLWQKKPRYEIRWKVIESVSSDGHEYIYVDPMQLPYDSTWELPRDQLVLGRTLGSGAFGQVVEATAHGLSHSQATMKVAVKMLKSTARSSEKQALMSELKIMSHLGPHLNVVNLLGACTKGGPIYIITEYCRYGDLVDYLHRNKHTFLQHHSDKRRPPSAELYSNALPVGLPLPSHVSLTGESDGGYMDMSKDESVDYVPMLDMKGDVKYADIESSNYMAPYDNYVPSAPERTCRATLINESPVLSYMDLVGFSYQVANGMEFLASKNCVHRDLAARNVLICEGKLVKICDFGLARDIMRDSNYISKGSTFLPLKWMAPESIFNSLYTTLSDVWSFGILLWEIFTLGGTPYPELPMNEQFYNAIKRGYRMAQPAHASDEIYEIMQKCWEEKFEIRPPFSQLVLLLERLLGEGYKKKYQQVDEEFLRSDHPAILRSQARLPGFHGLRSPLDTSSVLYTAVQPNEGDNDYIIPLPDPKPEVADEGPLEGSPSLASSTLNEVNTSSTISCDSPLEPQDEPEPEPQLELQVEPEPELEQLPDSGCPAPRAEAEDSFL

SEQ ID NO: 5 - DNA, 340 bp, Homo sapien
gacatccagatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtacacttttggccaggggaccaagctggagatcaaac

SEQ ID NO: 6 - protein, 113 aa, Homo sapien
DIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPYTFGQGTKLEIK

SEQ ID NO: 7 - DNA, 364 bp, Homo sapien
gaagttcaattgttagagtctggtggcggtcttgttcagcctggtggttctttacgtctttcttgcgctgcttccggattcactttctctaagtacaagatgctttgggttcgccaagctcctggtaaaggtttggagtgggtttcttctatctatccttctggtggcgttactttttatgctgactccgttaaaggtcgcttcactatctctagagacaactctaagaatactctctacttgcagatgaacagcttaagggctgaggacacggccgtgtattactgtgcaagagatggggagatgatttcgggtagtttctttgactcctggggccagggaaccctggtcaccgtctcaagcg

SEQ ID NO: 8 - protein, 121 aa, Homo sapien
EVQLLESGGGLVQPGGSLRLSCAASGFTFSKYKMLWVRQAPGKGLEWVSSIYPSGGVTFYADSVKGRFTISRDNSKNTLYLQMNSLRAEDTAVYYCARDGEMISGSFFDSWGQGTLVTVSS

SEQ ID NO: 9 - DNA, 340 bp, Homo sapien; identical to SEQ ID NO: 5

SEQ ID NO: 10 - protein, 113 aa, Homo sapien; identical to SEQ ID NO: 6

SEQ ID NO: 11 - DNA, 364 bp, Homo sapien
gaagttcaattgttagagtctggtggcggtcttgttcagcctggtggttctttacgtctttcttgcgctgcttccggattcactttctctcagtacatgatgctttgggttcgccaagctcctggtaaaggtttggagtgggtttctggtatctctccttctggtggcattactacttatgctgactccgttaaaggtcgcttcactatctctagagacaactctaagaatactctctacttgcagatgaacagcttaagggctgaggacacggccgtgtattactgtgcgagagcttatagcagtggctggtccttaccctttgactactggggccagggaaccctggtcaccgtctcaagcg

SEQ ID NO: 12 - protein, 121 aa, Homo sapien
EVQLLESGGGLVQPGGSLRLSCAASGFTFSQYMMLWVRQAPGKGLEWVSGISPSGGITTYADSVKGRFTISRDNSKNTLYLQMNSLRAEDTAVYYCARAYSSGWSLPFDYWGQGTLVTVSS

SEQ ID NO: 13 - DNA, 340 bp, Homo sapien
gacatccagatgacccagtctccagactccctggctgtgtctctgggcgagagggtcaccatcaactgcaagtccagccagagtgttttatacagctccaacaataagaactacttagcttggtaccagcagaaaccaggacagcctcctaagctactcatttactgggcatctacccgggaatccggggtccctgcccgattcagtggcagcgggtctgggacagatttcactctcaccatcagcagcctgcaggctgaagatgtggcagtttattactgtcagcaatattatagtactccgttcacttttggccaggggaccaagctggagatcatgc

SEQ ID NO: 14 - protein, 113 aa, Homo sapien
DIQMTQSPDSLAVSLGERVTINCKSSQSVLYSSNNKNYLAWYQQKPGQPPKLLIYWASTRESGVPARFSGSGSGTDFTLTISSLQAEDVAVYYCQQYYSTPFTFGQGTKLEIM

SEQ ID NO: 15 - DNA, 364 bp, Homo sapien; identical to SEQ ID NO: 11

SEQ ID NO: 16 - protein, 121 aa, Homo sapien; identical to SEQ ID NO: 12

SEQ ID NO: 17 - DNA, 322 bp, Homo sapien
gacatccagatgacccagtctccactctccctgtctgcatctgtgggagacagagtcaccatcacttgccgggcaagtcagagtgttggcagttatttaaattggtatcagcagaaaccagggaaagcccctaagctcctgatttttgctgcatacagtttgcaaactggggtcccatcaaggttcagtggcagtggatctgagacagaattctctctcacaatcagcggcctgcagcctgaagattttgcaacttattactgtcaacagcttaatttttaccctttcactttcggccctgggaccacagtggatatcaaac

SEQ ID NO: 18 - protein, 107 aa, Homo sapien
DIQMTQSPLSLSASVGDRVTITCRASQSVGSYLNWYQQKPGKAPKLLIFAAYSLQTGVPSRFSGSGSETEFSLTISGLQPEDFATYYCQQLNFYPFTFGPGTTVDIK

SEQ ID NO: 19 - DNA, 379 bp, Homo sapien
gaagttcaattgttagagtctggtggcggtcttgttcagcctggtggttctttacgtctttcttgcgctgcttccggattcactttctctaattaccatatgttttgggttcgccaagctcctggtaaaggtttggagtgggtttctgttatctctccttctggtggctctactggttatgctgactccgttaaaggtcgcttcactatctctagagacaactctaagaatactctctacttgcagatgaacagcttaagggctgaggacaccgccatgtattactgtgcgagatttgacggtgattacctttgggacgattatcgccatgatgcttttgatatctggggccaagggacaatggtcaccgtctcaagcg

SEQ ID NO: 20 - protein, 126 aa, Homo sapien
EVQLLESGGGLVQPGGSLRLSCAASGFTFSNYHMFWVRQAPGKGLEWVSVISPSGGSTGYADSVKGRFTISRDNSKNTLYLQMNSLRAEDTAMYYCARFDGDYLWDDYRHDAFDIWGQGTMVTVSS

SEQ ID NO: 21 - DNA, 340 bp, Homo sapien
gccatccagttgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttaccgggcatctacccgggaatccggggtccctgaccgattcagtggcagcgggtctgggacagatttcactctcaccatcagcagcctgcaggctgaagatgtggcagtttattactgtcagcaatattatagtaccccgtggacgttcggccaagggaccaaggtggaaatcaaac

SEQ ID NO: 22 - protein, 113 aa, Homo sapien
AIQLTQSPDSLAVSLGERATINCKSSQSVLYSSNNKNYLAWYQQKPGQPPKLLIYRASTRESGVPDRFSGSGSGTDFTLTISSLQAEDVAVYYCQQYYSTPWTFGQGTKVEIK

SEQ ID NO: 23 - DNA, 367 bp, Homo sapien
gaagttcaattgttagagtctggtggcggtcttgttcagcctggtggttctttacgtctttcttgcgctgcttccggattcactttctctaagtacaagatgcagtgggttcgccaagctcctggtaaaggtttggagtgggtttcttctatctctccttctggtggccttactttttatgctgactccgttaaaggtcgcttcactatctctagagacaactctaagaatactctctacttgcagatgaacagcttaagggctgaggacacggccgtgtattactgtgcgaaagcccgtcggatgagaagcctatgggaggcttttgatatctggggccaagggacaatggtcaccgtctcaagcg

SEQ ID NO: 24 - protein, 122 aa, Homo sapien
EVQLLESGGGLVQPGGSLRLSCAASGFTFSKYKMQWVRQAPGKGLEWVSSISPSGGLTFYADSVKGRFTISRDNSKNTLYLQMNSLRAEDTAVYYCAKARRMRSLWEAFDIWGQGTMVTVSS

SEQ ID NO: 25 - DNA, 340 bp, Homo sapien
gccatccagttgacccagtctccggactccctggctgtgtctctgggcgagagggccaccatcaactgtaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtacacttttggccaggggaccaaggtggagatcaaac

SEQ ID NO: 26 - protein, 113 aa, Homo sapien
AIQLTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPYTFGQGTKVEIK

SEQ ID NO: 27 - DNA, 364 bp, Homo sapien
gaagttcaattgttagagtctggtggcggtcttgttcagcctggtggttctttacgtctttcttgcgctgcttccggattcactttctctaagtacaagatgctttgggttcgccaagctcctggtaaaggtttggagtgggtttcttctatctatccttctggtggcgttactttttatgctgactccgttaaaggtcgcttcactatctctagagacaactctaagaatactctctacttgcagatgaacagcttaagggctgaggacacggccgtgtattactgtgcaagagatggggagatgatttcgggtagtttctttgactcctggggccaggggaccctggtcaccgtctcaagcg

SEQ ID NO: 28 - protein, 121 aa, Homo sapien; identical to SEQ ID NO: 8

SEQ ID NO: 29 - DNA, 340 bp, Homo sapien
gccatccggatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtacacttttggccaggggaccaagctggagatcaaac

SEQ ID NO: 30 - protein, 113 aa, Homo sapien
AIRMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPYTFGQGTKLEIK

SEQ ID NO: 31 - DNA, 364 bp, Homo sapien; identical to SEQ ID NO: 27

SEQ ID NO: 32 - protein, 121 aa, Homo sapien; identical to SEQ ID NO: 8

SEQ ID NO: 33 - DNA, 340 bp, Homo sapien
gccatccagatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagayttcactctcaccatcagcagcctgcaggctgaagatgtggcagtttattactgtcagcaatattatagtacyccgtggacgttcggccaagggaccaaggtggaaatcaarc

SEQ ID NO: 34 - protein, 113 aa, Homo sapien
AIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPWTFGQGTKVEIK

SEQ ID NO: 35 - DNA, 364 bp, Homo sapien
gaagttcaattgttagagtctggtggcggtcttgttcagcctggtggttctttacgtctttcttgcgctgcttccggattcactttctctcgttacgttatgacttgggttcgccaagctcctggtaaaggtttggagtgggtttcttctatctggccttctggtggcatgactgtttatgctgactccgttaaaggtcgcttcactatctctagagacaactctaagaatactctctacttgcagatgaacagcttaagggctgaggacacggccgtgtattactgtgcgagagatcgtcctaccgggaaaacgggatacttccagcactggggccagggcaccctggtcactgtctcaagcg

SEQ ID NO: 36 - protein, 121 aa, Homo sapien
EVQLLESGGGLVQPGGSLRLSCAASGFTFSRYVMTWVRQAPGKGLEWVSSIWPSGGMTVYADSVKGRFTISRDNSKNTLYLQMNSLRAEDTAVYYCARDRPTGKTGYFQHWGQGTLVTVSS

SEQ ID NO: 37 - DNA, 340 bp, Homo sapien
gccatccagatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtacacttttggccaggggaccaagctggagatcaaac

SEQ ID NO: 38 - protein, 113 aa, Homo sapien
AIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPYTFGQGTKLEIK

SEQ ID NO: 39 - DNA, 364 bp, Homo sapien; identical to SEQ ID NO: 27

SEQ ID NO: 40 - protein, 121 aa, Homo sapien; identical to SEQ ID NO: 8

SEQ ID NO: 41 - DNA, 340 bp, Homo sapien
gccatctggatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtacacttttggccaggggaccaagctggagatcaaac

SEQ ID NO: 42 - protein, 113 aa, Homo sapien
AIWMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPYTFGQGTKLEIK

SEQ ID NO: 43 - DNA, 364 bp, Homo sapien
gaagttcaattgttagagtctggtggcggtcttgttcagcctggtggttctttacgtctttcttgcgctgcttccggattcactttctctcagtacatgatgctttgggttcgccaagctcctggtaaaggtttggagtgggtttctggtatctctccttctggtggcattactacttatgctgactccgttaaaggtcgcttcactatctctagagacaactctaagaatactctctacttgcagatgaacagcttaagggctgaggacacggccgtgtattactgtgcgagagcttatagcagtggctggtccttaccctttgactactggggccaggggaccctggtcaccgtctcaagcg

SEQ ID NO: 44 - protein, 121 aa, Homo sapien; identical to SEQ ID NO: 12

SEQ ID NO: 45 - DNA, 340 bp, Homo sapien
gccatccagatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcccatcaccttcggccaagggacacgactggagattaaac

SEQ ID NO: 46 - protein, 113 aa, Homo sapien
AIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPITFGQGTRLEIK

SEQ ID NO: 47 - DNA, 367 bp, Homo sapien
gaagttcaattgttagagtctggtggcggtcttgttcagcctggtggttctttacgtctttcttgcgctgcttccggattcactttctctatgtactttatgtcttgggttcgccaagctcctggtaaaggtttggagtgggtttctggtatctctccttctggtggcatgactttttatgctgactccgttaaaggtcgcttcactatctctagagacaactctaagaatactctctacttgcagatgaacagcttaagggctgaggacacggccgtgtattactgtgcaaaagatggcatccccctatctatagctgcgccgattgactactggggccaggggaccctggtcaccgtctcaagcg

SEQ ID NO: 48 - protein, 122 aa, Homo sapien
EVQLLESGGGLVQPGGSLRLSCAASGFTFSMYFMSWVRQAPGKGLEWVSGISPSGGMTFYADSVKGRFTISRDNSKNTLYLQMNSLRAEDTAVYYCAKDGIPLSIAAPIDYWGQGTLVTVSS

SEQ ID NO: 49 - DNA, 340 bp, Homo sapien
gacatcgtgatgacccagtctccagactccctggctgtgtctctgggcgagagggccaccatcaactgcaagtccagccagagtgttttatacagttccaacaataagaactacttagcctggtaccagcagaagccaggacagcctcctaagttgctcatttactgggcatctacccgggaatccggggtccctgaccgattcagtggcagcgggtctgggacagatttcactctcaccatcagcagcctgcaggctgaagatgtggcagtttattactgtcagcaatattatagtattccgtggacgttcggccaagggaccaaggtggaaatcaaac

SEQ ID NO: 50 - protein, 113 aa, Homo sapien
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSIPWTFGQGTKVEIK

SEQ ID NO: 51 - DNA, 364 bp, Homo sapien
gaagttcaattgttagagtctggtggcggtcttgttcagcctggtggttctttacgtctttcttgcgctgcttccggactcactttctctcgttacgttatgacttgggttcgccaagctcctggtaaaggtttggagtgggtttcttctatctggccttctggtggcatgactgtttatgctgactccgttaaaggtcgcttcactatctctagagacaactctaagaatactctctacttgcagatgaacagcttaagggctgaggacacggccgtgtattactgtgcgagagatcgtcctaccgggaaaacgggatacttccagcactggggccagggcaccctggtcactgtctcaagcg

SEQ ID NO: 52 - protein, 121 aa, Homo sapien
EVQLLESGGGLVQPGGSLRLSCAASGLTFSRYVMTWVRQAPGKGLEWVSSIWPSGGMTVYADSVKGRFTISRDNSKNTLYLQMNSLRAEDTAVYYCARDRPTGKTGYFQHWGQGTLVTVSS

SEQ ID NO: 53 - DNA, 340 bp, Homo sapien
aacatccagatgacccagtctccagactccctggctgtgtctctgggcgagagggtcaccatcaactgcaagtccagccagagtgttttatacagctccaacaataagaactacttagcttggtaccagcagaaaccaggacagcctcctaagctactcatttactgggcatctacccgggaatccggggtccctgcccgattcagtggcagcgggtctgggacagatttcactctcaccatcagcagcctgcaggctgaagatgtggcagtttattactgtcagcaatattatagtactccgttcacttttggccaggggaccaaggtggaaatcaagc

SEQ ID NO: 54 - protein, 113 aa, Homo sapien
NIQMTQSPDSLAVSLGERVTINCKSSQSVLYSSNNKNYLAWYQQKPGQPPKLLIYWASTRESGVPARFSGSGSGTDFTLTISSLQAEDVAVYYCQQYYSTPFTFGQGTKVEIK

SEQ ID NO: 55 - DNA, 364 bp, Homo sapien; identical to SEQ ID NO: 43

SEQ ID NO: 56 - protein, 121 aa, Homo sapien; identical to SEQ ID NO: 12

SEQ ID NO: 57 - DNA, 340 bp, Homo sapien
gccatccagatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtaccccgtggacgttcggccaagggaccaagctggagatcaaac

SEQ ID NO: 58 - protein, 113 aa, Homo sapien
AIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPWTFGQGTKLEIK

SEQ ID NO: 59 - DNA, 367 bp, Homo sapien
gaagttcaattgttagagtctggtggcggtcttgttcagcctggtggttctttacgtctttcttgcgctgcttccggattcactttctctggttacattatgcagtgggttcgccaagctcctggtaaaggtttggagtgggtttcttctatctctccttctggtggccttactttttatgctgactccgttaaaggtcgcttcactatctctagagacaactctaagaatactctctacttgcagatgaacagcttaagggctgaggacacggccgtgtattactgtgcgaaagcccgtcggatgagaagcctatgggaggcttttgatgtctggggccaagggaccacggtcaccgtctcaagcg

SEQ ID NO: 60 - protein, 122 aa, Homo sapien
EVQLLESGGGLVQPGGSLRLSCAASGFTFSGYIMQWVRQAPGKGLEWVSSISPSGGLTFYADSVKGRFTISRDNSKNTLYLQMNSLRAEDTAVYYCAKARRMRSLWEAFDVWGQGTTVTVSS

SEQ ID NO: 61 - DNA, 340 bp, Homo sapien
gccatccagatgacccagtctccagactccctggctgtgtctctgggcgagagggccaccatcaactgcaagtccagccagagtgttttatacagctccaacaataagaactacttagcttggtaccagcagaaaccaggacagtctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcccatcaccttcggccaagggacacgactggagcttagac

SEQ ID NO: 62 - protein, 113 aa, Homo sapien
AIQMTQSPDSLAVSLGERATINCKSSQSVLYSSNNKNYLAWYQQKPGQSPKLLIYWASTRESGVPDRFSGSGSGTDFTLTISSLQAEDVAVYYCQQYYSTPITFGQGTRLELR

SEQ ID NO: 63 - DNA, 367 bp, Homo sapien
gaagttcaattgttagagtctggtggcggtcttgttcagcctggtggttctttacgtctttcttgcgctgcttccggattcactttctctaagtacaagatggagtgggttcgccaagctcctggtaaaggtttggagtgggtttcttctatctctccttctggtggccttactttttatgctgactccgttaaaggtcgcttcactatctctagagacaactctaagaatactctctacttgcagatgaacagcttaagggctgaggacacggccgtgtattactgtgcgaaagcccgtcggatgagaagcctatgggaggcttttgatgtctggggccaagggacaatggtcaccgtctcaagcg

SEQ ID NO: 64 - protein, 122 aa, Homo sapien
EVQLLESGGGLVQPGGSLRLSCAASGFTFSKYKMEWVRQAPGKGLEWVSSISPSGGLTFYADSVKGRFTISRDNSKNTLYLQMNSLRAEDTAVYYCAKARRMRSLWEAFDVWGQGTMVTVSS

SEQ ID NO: 65 - DNA, 340 bp, Homo sapien; identical to SEQ ID NO: 21

SEQ ID NO: 66 - protein, 113 aa, Homo sapien; identical to SEQ ID NO: 22

SEQ ID NO: 67 - DNA, 367 bp, Homo sapien
gaagttcaattgttagagtctggtggcggtcttgttcagcctggtggttctttacgtctttcttgcgctgcttccggattcactttctctaattactctatgacgtgggttcgccaagctcctggtaaaggtttggagtgggtttcttctatctctccttctggtggccttactttttatgctgactccgttaaaggtcgcttcactatctctagagacaactctaagaatactctctacttgcagatgaacagcttaagggctgaggacacggccgtgtattactgtgcgaaagcccgtcggatgagaagcctatgggaggcttttgatatctggggccaagggacaatggtcaccgtctcaagcg

SEQ ID NO: 68 - protein, 122 aa, Homo sapien
EVQLLESGGGLVQPGGSLRLSCAASGFTFSNYSMTWVRQAPGKGLEWVSSISPSGGLTFYADSVKGRFTISRDNSKNTLYLQMNSLRAEDTAVYYCAKARRMRSLWEAFDIWGQGTMVTVSS

SEQ ID NO: 69 - DNA, 340 bp, Homo sapien
gaaatagtgatgacgcagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtggacgttcggccaagggaccaaggtggaaatcaaac

SEQ ID NO: 70 - protein, 113 aa, Homo sapien
EIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPWTFGQGTKVEIK

SEQ ID NO: 71 - DNA, 364 bp, Homo sapien
gaagttcaattgttagagtctggtggcggtcttgttcagcctggtggttctttacgtctttcttgcgctgcttccggattcactttctctaagtaccctatgacttgggttcgccaagctcctggtaaaggtttggagtgggtttcttctatctggccttctggtggcatgactgtttatgctgactccgttaaaggtcgcttcactatctctagagacaactctaagaatactctctacttgcagatgaacagcttaagggctgaggacacggccgtgtattactgtgcgagagatcgtcctaccgggaaaacgggatacttccagcactggggccagggcaccctggtcactgtctcaagcg

SEQ ID NO: 72 - protein, 121 aa, Homo sapien
EVQLLESGGGLVQPGGSLRLSCAASGFTFSKYPMTWVRQAPGKGLEWVSSIWPSGGMTVYADSVKGRFTISRDNSKNTLYLQMNSLRAEDTAVYYCARDRPTGKTGYFQHWGQGTLVTVSS

SEQ ID NO: 73 - DNA, 340 bp, Homo sapien
gacatccagatgacccagtctccagactccctggctgtgtctctgggcgagagggccaccatcaactgcaagtccagccagagtgttttatacagctccaacaataagaactacttagcttggtaccagcagaaaccaggacagcctcctaagctactcatttactgggcatctacccgggaatccggggtccctgaccgattcagtggcagcgggtctgggacagatttcactctcaccatcagcagcctgcaggctgaagatgtggcagtttattactgtcagcaatattatagtactccgtacacttttggccaggggaccaagctggagatcaaac

SEQ ID NO: 74 - protein, 113 aa, Homo sapien; identical to SEQ ID NO: 6

SEQ ID NO: 75 - DNA, 364 bp, Homo sapien
gaagttcaattgttagagtctggtggcggtcttgttcagcctggtggttctttacgtctttcttgcgctgcttccggattcactttctctcagtacatgatgctttgggttcgccaagctcctggtaaaggtttggagtgggtttctggtatctctccttctggtggcattactacttatgctgactccgttaaaggtcgcttcactatctctagagacaactctaagaatactctctacttgcggatgaacagcttaagggctgaggacacggccgtgtattactgtgcgagagcttatagcagtggctggtccttaccctttgactactggggccaggggaccctggtcaccgtctcaagcg

SEQ ID NO: 76 - protein, 121 aa, Homo sapien
EVQLLESGGGLVQPGGSLRLSCAASGFTFSQYMMLWVRQAPGKGLEWVSGISPSGGITTYADSVKGRFTISRDNSKNTLYLRMNSLRAEDTAVYYCARAYSSGWSLPFDYWGQGTLVTVSS

SEQ ID NO: 77 - DNA, 340 bp, Homo sapien; identical to SEQ ID NO: 37

SEQ ID NO: 78 - protein, 113 aa, Homo sapien; identical to SEQ ID NO: 38

SEQ ID NO: 79 - DNA, 364 bp, Homo sapien
gaagttcaattgttagagtctggtggcggtcttgttcagcctggtggttctttacgtctttcttgcgctgcttccggattcactttctctatgtacatgatgctttgggttcgccaagctcctggtaaaggtttggagtgggtttctggtatctctccttctggtggcattactacttatgctgactccgttaaaggtcgcttcactatctctagagacaactctaagaatactctctacttgcagatgaacagcttaagggctgaggacacggccgtgtattactgtgcgagagcttatagcagtggctggtccttaccctttgactactggggccaggggaccctggtcaccgtctcaagcg

SEQ ID NO: 80 - protein, 121 aa, Homo sapien
EVQLLESGGGLVQPGGSLRLSCAASGFTFSMYMMLWVRQAPGKGLEWVSGISPSGGITTYADSVKGRFTISRDNSKNTLYLQMNSLRAEDTAVYYCARAYSSGWSLPFDYWGQGTLVTVSS

SEQ ID NO: 81 - DNA, 340 bp, Homo sapien
aacatccagatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtacacttttggccaggggaccaaggtggagatcaaac

SEQ ID NO: 82 - protein, 113 aa, Homo sapien
NIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPYTFGQGTKVEIK

SEQ ID NO: 83 - DNA, 364 bp, Homo sapien
gaagttcaattgttagagtctggtggcggtcttgttcagcctggtggttctttacgtctttcttgcgctgcttccggattcactttctctcagtacatgatgctttgggttcgccaagctcctggtaaaggtttggagtgggtttctggtatctctccttctggtggcattactacttatgctgactccgttaaaggtcgcttcactatctctagagacaactctaagaatactctctacttgcagatgaacagcttaagggctgaggacacggccgtgtattactgtgcgagagcttatagcagtggctggtccttaccctttgactactggggccagggcaccctggtcaccgtctcaagcg

SEQ ID NO: 84 - protein, 121 aa, Homo sapien; identical to SEQ ID NO: 12

SEQ ID NO: 85 - DNA, 340 bp, Homo sapien
gacatccagttgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtggacgttcggccaagggaccaaggtggaaatcaaac

SEQ ID NO: 86 - protein, 113 aa, Homo sapien
DIQLTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPWTFGQGTKVEIK

SEQ ID NO: 87 - DNA, 367 bp, Homo sapien
gaagttcaattgttagagtctggtggcggtcttgttcagcctggtggttctttacgtctttcttgcgctgcttccggattcactttctctaagtaccctatgacttgggttcgccaagctcctggtaaaggtttggagtgggtttcttctatctctccttctggtggccttactttttatgctgactccgttaaaggtcgcttcactatctctagagacaactctaagaatactctctacttgcagatgaacagcttaagggctgaggacacggccgtgtattactgtgcgaaagcccgtcggatgagaagcctatgggaggcttttgatgtctggggccaagggacaatggtcaccgtctcaagcg

SEQ ID NO: 88 - protein, 122 aa, Homo sapien
EVQLLESGGGLVQPGGSLRLSCAASGFTFSKYPMTWVRQAPGKGLEWVSSISPSGGLTFYADSVKGRFTISRDNSKNTLYLQMNSLRAEDTAVYYCAKARRMRSLWEAFDVWGQGTMVTVSS

SEQ ID NO: 89 - DNA, 340 bp, Homo sapien
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtaccccgtggacgttcggccaagggaccaaggtggaaatcaagc

SEQ ID NO: 90 - protein, 113 aa, Homo sapien
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPWTFGQGTKVEIK

SEQ ID NO: 91 - DNA, 364 bp, Homo sapien; identical to SEQ ID NO: 35

SEQ ID NO: 92 - protein, 121 aa, Homo sapien; identical to SEQ ID NO: 36

SEQ ID NO: 93 - DNA, 340 bp, Homo sapien; identical to SEQ ID NO: 85

SEQ ID NO: 94 - protein, 113 aa, Homo sapien; identical to SEQ ID NO: 86

SEQ ID NO: 95 - DNA, 364 bp, Homo sapien
gaagttcaattgttagagtctggtggcggtcttgttcagcctggtggttctttacgtctttcttgcgctgcttccggattcactttctctcgttacgttatgacttgggttcgccaagctcctggtaaaggtttggagtgggtttcttctatctggccttctggtggcatgactgtttatgctgactccgttaaaggtcgcttcactatctctagagacaactctaagaatactctctacttgcagatgaacagcttaagggctgaggacacggccgtgtattactgtgcgagagatcgtcctaccgggaaaacgggatacttccagcactggggccagggcaccctggtcaccgtctcaagcg

SEQ ID NO: 96 - protein, 121 aa, Homo sapien; identical to SEQ ID NO: 36

SEQ ID NO: 97 - DNA, 340 bp, Homo sapien
gccatccagatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgcgaatcgggggtccctgaccgattcagtggcaccgggtctgggacagatttcactctcaccatcagcagcctgcaggctgaagatgtggcagtttattactgtcagcaatattatagtactccattcaccttcggccaagggacacgactggagcttagac

SEQ ID NO: 98 - protein, 113 aa, Homo sapien
AIQMTQSPDSLAVSLGERATINCKSSQSVLYSSNNKNYLAWYQQKPGQPPKLLIYWASTRESGVPDRFSGTGSGTDFTLTISSLQAEDVAVYYCQQYYSTPFTFGQGTRLELR

SEQ ID NO: 99 - DNA, 364 bp, Homo sapien; identical to SEQ ID NO: 27

SEQ ID NO: 100 - protein, 121 aa, Homo sapien; identical to SEQ ID NO: 8

SEQ ID NO: 101 - DNA, 340 bp, Homo sapien
gccatccagatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgrttcagtggcagcgggtctgggacagatttcactctcaccatcagcagcctgcaggctgaagatgtggcagtttattactgtcagcaatattatagtactccgtacacttttggccaggggaccaagctggagatcaaac

SEQ ID NO: 102 - protein, 113 aa, Homo sapien; identical to SEQ ID NO: 38

SEQ ID NO: 103 - DNA, 364 bp, Homo sapien
gaagttcaattgttagagtctggtggcggtcttgttcagcctggtggttctttacgtctttcttgcgctgcttccggattcactttctctcagtacatgatgctttgggttcgccaagctcctggtaaaggtttggagtgggtttctggtatctctccttctggtggcattactacttatgctgactccgttaaaggtcgcttcactatctctagagacaactctaagaatactctctacttgcagatgaacagcttaagggctgaggacacggccgtgtattactgtgcgagrgcttatagcagtggctggtccttaccctttgactactggggccagggsaccctggtcacygtctcaagcg

SEQ ID NO: 104 - protein, 121 aa, Homo sapien; identical to SEQ ID NO: 12

SEQ ID NO: 105 - DNA, 340 bp, Homo sapien
aacatccagatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtacacttttggccaggggaccaagctggagatcaaac

SEQ ID NO: 106 - protein, 113 aa, Homo sapien
NIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPYTFGQGTKLEIK

SEQ ID NO: 107 - DNA, 364 bp, Homo sapien
gaagttcaattgttagagtctggtggcggtcttgttcagcctggtggttctttacgtctttcttgcgctgcttccggattcactttctctcagtacatgatgctttgggttcgccaagctcctggtaaaggtttggagtgggtttctggtatctctccttctggtggcattactacttatgctgactccgttaaaggtcgcttcactatctctagagacaactctaagaatactctctacttgcagatgaacagcttaagggctgaggacacggccgtgtattactgtgcgagagcttatagcagtggctggtccttaccctttgactactggggccagggcaccctggtcacygtctcaagcg

SEQ ID NO: 108 - protein, 121 aa, Homo sapien; identical to SEQ ID NO: 12

SEQ ID NO: 109 - DNA, 340 bp, Homo sapien
gacatccagttgacccagtctccaggctccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtacacttttggccaggggaccaagctggagatcaaac

SEQ ID NO: 110 - protein, 113 aa, Homo sapien
DIQLTQSPGSLAVSLGERATINCKSSQSVLYSSNNKNYLAWYQQKPGQPPKLLIYWASTRESGVPDRFSGSGSGTDFTLTISSLQAEDVAVYYCQQYYSTPYTFGQGTKLEIK

SEQ ID NO: 111 - DNA, 364 bp, Homo sapien; identical to SEQ ID NO: 43

SEQ ID NO: 112 - protein, 121 aa, Homo sapien; identical to SEQ ID NO: 12

SEQ ID NO: 113 - DNA, 340 bp, Homo sapien; identical to SEQ ID NO: 29

SEQ ID NO: 114 - protein, 113 aa, Homo sapien; identical to SEQ ID NO: 30

SEQ ID NO: 115 - DNA, 364 bp, Homo sapien
gaagttcaattgttagagtctggtggcggtcttgttcagcctggtggttctttacgtctttcttgcgctgcttccggattcactttctctcagtacatgatgctttgggttcgccaagctcctggtaaaggtttggagtgggtttctggtatctctccttctggtggcattactacttatgctgactccgttaaaggtcgcttcactatctctagagacaactctaagaatactctctacttgcagatgaacagcttaagggctgaggacacggccgtgtattactgtgcgagagcttatagcagtggctggtccttaccctttgactactggggccagggsaccctggtcaccgtctcaagcg

SEQ ID NO: 116 - protein, 121 aa, Homo sapien; identical to SEQ ID NO: 12

SEQ ID NO: 117 - DNA, 340 bp, Homo sapien
gccatccagatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacrgayttcactctcaccatcagcagcctgcaggctgaagatgtggcagtttattactgtcagcaatattatagtactcccatcaccttcggccaagggacacgactggagattaaac

SEQ ID NO: 118 - protein, 113 aa, Homo sapien; identical to SEQ ID NO: 46

SEQ ID NO: 119 - DNA, 367 bp, Homo sapien
gaagtycaattgttagagtctggtggcggtcttgttcagcctggtggttctttacgtctttcttgcgctgcttccggattcactttctctaagtacaagatggagtgggttcgccaagctcctggtaaaggtttggagtgggtttcttctatctctccttctggtggccttactttttatgctgactccgttaaaggtcgcttcactatctctagagacaactctaagaatactctctacttgcagatgaacagcttaagggctgaggacacggccgtgtattactgtgcgaaagcccgtcggatgagaagcctatgggaggcttttgatgtctggggccaagggacaatggtcaccgtctcaagcg

SEQ ID NO: 120 - protein, 122 aa, Homo sapien; identical to SEQ ID NO: 64

SEQ ID NO: 121 - DNA, 340 bp, Homo sapien
gccatccagttgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcccatcaccttcggccaagggacacgactggagattaaac

SEQ ID NO: 122 - protein, 113 aa, Homo sapien
AIQLTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPITFGQGTRLEIK

SEQ ID NO: 123 - DNA, 367 bp, Homo sapien; identical to SEQ ID NO: 63

SEQ ID NO: 124 - protein, 122 aa, Homo sapien; identical to SEQ ID NO: 64

SEQ ID NO: 125 - DNA, 340 bp, Homo sapien
gccatccagatgacccagtctccagactccctggctgtgtctctgggcgagagggccaccatcaactgcaagtccagccagagtgttttatacagctccaacaataagaactacttagcttggtaccagcagaaaccaggacagcctcctaggctgctcatttactgggcatctacccgggaatccggggtccctgcccgattcagtggcagcgggtctgggacagatttcactctcaccatcagcagcctgcaggctgaagatgtggcagtttattactgtcagcaatattatagtactccgttcacttttggccaggggaccaagctggagatcaaac

SEQ ID NO: 126 - protein, 113 aa, Homo sapien
AIQMTQSPDSLAVSLGERATINCKSSQSVLYSSNNKNYLAWYQQKPGQPPRLLIYWASTRESGVPARFSGSGSGTDFTLTISSLQAEDVAVYYCQQYYSTPFTFGQGTKLEIK

SEQ ID NO: 127 - DNA, 367 bp, Homo sapien
gaagttcaattgttagagtctggtggcggtcttgttcagcctggtggttctttacgtctttcttgcgctgcttccggattcactttctctaagtacaagatgctttgggttcgccaagctcctggtaaaggtttggagtgggtttcttctatctctccttctggtggccttactttttatgctgactccgttaaaggtcgcttcactatctctagagacaactctaagaatactctctacttgcagatgaacagcttaagggctgaggacacggccgcgtattactgtgcgaaagcccgtcggatgagaagcctatgggaggcttttgatgtctggggccaagggacaatggtcaccgtctcaagcg

SEQ ID NO: 128 - protein, 122 aa, Homo sapien
EVQLLESGGGLVQPGGSLRLSCAASGFTFSKYKMLWVRQAPGKGLEWVSSISPSGGLTFYADSVKGRFTISRDNSKNTLYLQMNSLRAEDTAAYYCAKARRMRSLWEAFDVWGQGTMVTVSS

SEQ ID NO: 129 - DNA, 340 bp, Homo sapien
aacatccagatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcccatcaccttcggccaagggacacgactggagcttagac

SEQ ID NO: 130 - protein, 113 aa, Homo sapien
NIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPITFGQGTRLELR

SEQ ID NO: 131 - DNA, 367 bp, Homo sapien; identical to SEQ ID NO: 63

SEQ ID NO: 132 - protein, 122 aa, Homo sapien; identical to SEQ ID NO: 64

SEQ ID NO: 133 - DNA, 340 bp, Homo sapien
gccatccagttgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtacacttttggccaggggaccaagctggagatcaaac

SEQ ID NO: 134 - protein, 113 aa, Homo sapien
AIQLTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPYTFGQGTKLEIK

SEQ ID NO: 135 - DNA, 364 bp, Homo sapien; identical to SEQ ID NO: 43

SEQ ID NO: 136 - protein, 121 aa, Homo sapien; identical to SEQ ID NO: 12

SEQ ID NO: 137 - DNA, 340 bp, Homo sapien
gccatccagatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtggacgttcggccaagggaccaaggtggagatcaaac

SEQ ID NO: 138 - protein, 113 aa, Homo sapien; identical to SEQ ID NO: 34

SEQ ID NO: 139 - DNA, 361 bp, Homo sapien
gaagttcaattgttagagtctggtggcggtcttgttcagcctggtggttctttacgtctttcttgcgctgcttccggattcactttctctaagtaccctatggtttgggttcgccaagctcctggtaaaggtttggagtgggtttcttctatctctccttctggtggccttactttttatgctgactccgttaaaggtcgcttcactatctctagagacaactctaagaatactctctacttgcagatgaacagcttaagggctgaggacacggccgtgtattactgtgcgaaagcccgtcggatgagaagcctatgggaggcttttgatgtctggggccaagggaccacggtcaccgtct

SEQ ID NO: 140 - protein, 120 aa, Homo sapien
EVQLLESGGGLVQPGGSLRLSCAASGFTFSKYPMVWVRQAPGKGLEWVSSISPSGGLTFYADSVKGRFTISRDNSKNTLYLQMNSLRAEDTAVYYCAKARRMRSLWEAFDVWGQGTTVTV

SEQ ID NO: 141 - DNA, 340 bp, Homo sapien
gccatccagatgacccagtctccagactccctggctgtgtctctgggcgagagggccaccatcaactgcaagtccagccagagtcttttgtacagtgccaacaataagaactacttagcttggtaccagcagaaaccgggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtaccccgtggacgttcggccaagggaccaaggtggaaatcaaac

SEQ ID NO: 142 - protein, 113 aa, Homo sapien
AIQMTQSPDSLAVSLGERATINCKSSQSLLYSANNKNYLAWYQQKPGQPPKLLIYWASTRESGVPDRFSGSGSGTDFTLTISSLQAEDVAVYYCQQYYSTPWTFGQGTKVEIK

SEQ ID NO: 143 - DNA, 364 bp, Homo sapien; identical to SEQ ID NO: 35

SEQ ID NO: 144 - protein, 121 aa, Homo sapien; identical to SEQ ID NO: 36

SEQ ID NO: 145 - DNA, 340 bp, Homo sapien; identical to SEQ ID NO: 129

SEQ ID NO: 146 - protein, 113 aa, Homo sapien; identical to SEQ ID NO: 130

SEQ ID NO: 147 - DNA, 364 bp, Homo sapien
gaagttcaattgttagagtctggtggcggtcttgttcagcctggtggttctttacgtctttcttgcgctgcttccggattcactttctctaagtacatgatgggctgggttcgccaagctcctggtaaaggtttggagtgggtttctggtatctctccttctggtggcattactacttatgctgactccgttaaaggtcgcttcactatctctagagacaactctaagaatactctctacttgcagatgaacagcttaagggctgaggacacggccgtgtattactgtgcgagagcttatagcagtggctggtccttaccctttgactactggggccaggggaccctggtcaccgtctcaagcg

SEQ ID NO: 148 - protein, 121 aa, Homo sapien
EVQLLESGGGLVQPGGSLRLSCAASGFTFSKYMMGWVRQAPGKGLEWVSGISPSGGITTYADSVKGRFTISRDNSKNTLYLQMNSLRAEDTAVYYCARAYSSGWSLPFDYWGQGTLVTVSS

SEQ ID NO: 149 - DNA, 340 bp, Homo sapien
gccatccagatgacccagtctccagactccctggctgtgtctctgggcgagagggccaccatcaattgcaagtccagccagagtgttttatacagccccaacaagaagaactacttagcttggtaccagcaaaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtacacttttggccaggggaccaagctggagatcaaac

SEQ ID NO: 150 - protein, 113 aa, Homo sapien
AIQMTQSPDSLAVSLGERATINCKSSQSVLYSPNKKNYLAWYQQKPGQPPKLLIYWASTRESGVPDRFSGSGSGTDFTLTISSLQAEDVAVYYCQQYYSTPYTFGQGTKLEIK

SEQ ID NO: 151 - DNA, 364 bp, Homo sapien; identical to SEQ ID NO: 27

SEQ ID NO: 152 - protein, 121 aa, Homo sapien; identical to SEQ ID NO: 8

SEQ ID NO: 153 - DNA, 340 bp, Homo sapien
gaaattgtgttgacgcagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtggacgttcggccaagggacacgactggagattaaac

SEQ ID NO: 154 - protein, 113 aa, Homo sapien
EIVLTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPWTFGQGTRLEIK

SEQ ID NO: 155 - DNA, 367 bp, Homo sapien
gaagttcaattgttagagtctggtggcggtcttgttcagcctggtggttctttacgtctttcttgcgctgcttccggattcactttctctaagtaccctatggtttgggttcgccaagctcctggtaaaggtttggagtgggtttcttctatctctccttctggtggccttactttttatgctgactccgttaaaggtcgcttcactatctctagagacaactctaagaatactctctacttgcagatgaacagcttaagggctgaggacacggccgtgtattactgtgcgaaagcccgtcggatgagaagcctatgggaggcttttgatgtctggggccaagggaccctggtcaccgtctcaagcg

SEQ ID NO: 156 - protein, 122 aa, Homo sapien
EVQLLESGGGLVQPGGSLRLSCAASGFTFSKYPMVWVRQAPGKGLEWVSSISPSGGLTFYADSVKGRFTISRDNSKNTLYLQMNSLRAEDTAVYYCAKARRMRSLWEAFDVWGQGTLVTVSS

SEQ ID NO: 157 - DNA, 340 bp, Homo sapien
gccatctggatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcccatcaccttcggccaagggacacgactggagcttagac

SEQ ID NO: 158 - protein, 113 aa, Homo sapien
AIWMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPITFGQGTRLELR

SEQ ID NO: 159 - DNA, 367 bp, Homo sapien; identical to SEQ ID NO: 63

SEQ ID NO: 160 - protein, 122 aa, Homo sapien; identical to SEQ ID NO: 64

SEQ ID NO: 161 - DNA, 340 bp, Homo sapien
gccatccagatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtggacgttcggccaagggaccaaggtggaaatcaagc

SEQ ID NO: 162 - protein, 113 aa, Homo sapien; identical to SEQ ID NO: 34

SEQ ID NO: 163 - DNA, 367 bp, Homo sapien
gaagttcaattgttagagtctggtggcggtcttgttcagcctggtggttctttacgtctttcttgcgctgcttccggattcactttctctaagtaccgtatgtcttgggttcgccaagctcctggtaaaggtttggagtgggtttcttctatctctccttctggtggccttactttttatgctgactccgttaaaggtcgcttcactatctctagagacaactctaagaatactctctacttgcagatgaacagcttaagggctgaggacacggccgtgtattactgtgcgaaagcccgtcggatgagaagcctatgggaggcttttgatgtctggggccaagggaccctggtcaccgtctcaagcg

SEQ ID NO: 164 - protein, 122 aa, Homo sapien
EVQLLESGGGLVQPGGSLRLSCAASGFTFSKYRMSWVRQAPGKGLEWVSSISPSGGLTFYADSVKGRFTISRDNSKNTLYLQMNSLRAEDTAVYYCAKARRMRSLWEAFDVWGQGTLVTVSS

SEQ ID NO: 165 - DNA, 322 bp, Homo sapien
gacatcgtgatgacccagtctccatcctccctgtctgcatctgtaggagacagagtcaccatcacttgccgggcaagtcagagcattagcagctatttaaattggtattagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctgacgttcggccaagggaccaaggtggaaatcaagc

SEQ ID NO: 166 - protein, 107 aa, Homo sapien
DIVMTQSPSSLSASVGDRVTITCRASQSISSYLNWYQQKPGKAPKLLIYAASSLQSGVPSRFSGSGSGTDFTLTISSLQPEDFATYYCQQSYSTPLTFGQGTKVEIK

SEQ ID NO: 167 - DNA, 364 bp, Homo sapien
gaagttcaattgttagagtctggtggcggtcttgttcagcctggtggttctttacgtctttcttgcgctgcttccggattcactttctctaagtacgatatgcattgggttcgccaagctcctggtaaaggtttggagtgggtttctgttatctctccttctggtggctggacttcttatgctgactccgttaaaggtcgcttcactatctctagagacaactctaagaatactctctacttgcagatgaacagcttaagggctgaggacaccgccatgtattactgtgcgagggatgactacagtaaaggacgggatgcttttgatatctggggccaagggaccacggtcaccgtctcaagcg

SEQ ID NO: 168 - protein, 121 aa, Homo sapien
EVQLLESGGGLVQPGGSLRLSCAASGFTFSKYDMHWVRQAPGKGLEWVSVISPSGGWTSYADSVKGRFTISRDNSKNTLYLQMNSLRAEDTAMYYCARDDYSKGRDAFDIWGQGTTVTVSS

SEQ ID NO: 169 - DNA, 322 bp, Homo sapien
gatgttgtgatgacacagtctccatcctccctgtctgcatctgtaggagacagagtcaccatcacttgccgggcaagtcagagcattagcagctatttaaattggtattagcagaaaccagggaaagcccctaagctcctgatctatgctgcatccagtttgcaaagtggggtcccatcaaggttcagtggcagtggatctgggacagatttcactctcaccatcagcagtctgcaacctgaggattttgcaacttactactgtcagcagagttacactaccccgtacacttttggccaggggaccaagctggagatcaaac

SEQ ID NO: 170 - protein, 107 aa, Homo sapien
DVVMTQSPSSLSASVGDRVTITCRASQSISSYLNWYQQKPGKAPKLLIYAASSLQSGVPSRFSGSGSGTDFTLTISSLQPEDFATYYCQQSYTTPYTFGQGTKLEIK

SEQ ID NO: 171 - DNA, 340 bp, Homo sapien
gaagttcaattgttagagtctggtggcggtcttgttcagcctggtggttctttacgtctttcttgcgctgcttccggattcactttctctggttacattatgtggtgggttcgccaagctcctggtaaaggtttggagtgggtttctgttatctctccttctggtggcgatacttggtatgctgactccgttaaaggtcgcttcactatctctagagacaactctaagaatactctctacttgcagatgaacagcttaagggctgaggacacggccgtgtattactgtgccacagcgggagactactggggccagggcaccctggtcaccgtctcaagcg

SEQ ID NO: 172 - protein, 113 aa, Homo sapien
EVQLLESGGGLVQPGGSLRLSCAASGFTFSGYIMWWVRQAPGKGLEWVSVISPSGGDTWYADSVKGRFTISRDNSKNTLYLQMNSLRAEDTAVYYCATAGDYWGQGTLVTVSS

SEQ ID NO: 173 - DNA, 322 bp, Homo sapien
gccatccagatgacccagtctccatcctccctgtctgcatctgtaggagacagagtcaccatcacttgccgggcaagtcagagcattagcagctatttaaattggtattagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccccctcactttcggcggagggaccaaggtggagatcaaac

SEQ ID NO: 174 - protein, 107 aa, Homo sapien
AIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 175 - DNA, 364 bp, Homo sapien
gaagttcaattgttagagtctggtggcggtcttgttcagcctggtggttctttacgtctttcttgcgctgcttccggattcactttctctaagtacgatatgcattgggttcgccaagctcctggtaaaggtttggagtgggtttctgttatctctccttctggtggctggacttcttatgctgactccgttaaaggtcgcttcactatctctagagacaactctaagaatactctctacttgcagatgaacagcttaagggctgaggacaccgccatgtattactgtgcgagggatgactacagtaaaggacgggatgcttttgatatctggggccaagggaccctggtcaccgtctcaagcg

SEQ ID NO: 176 - protein, 121 aa, Homo sapien
EVQLLESGGGLVQPGGSLRLSCAASGFTFSKYDMHWVRQAPGKGLEWVSVISPSGGWTSYADSVKGRFTISRDNSKNTLYLQMNSLRAEDTAMYYCARDDYSKGRDAFDIWGQGTLVTVSS

SEQ ID NO: 177 - DNA, 322 bp, Homo sapien
gaaattgtgttgacacagtctccatcctccctgtctgcatctgtaggagacagagtcaccatcacttgccgggcaagtcagagcattagcagctatttaaattggtatcaacagaaaccagggaaagcccctaagctcctgatctatgctgcatccactttgcaaagtggggtcccatcaaggttcagtggcagtggatctgggacagatttcactctcaccatcagcagtctgcaacctgaagattttgcaacttactactgtcaacagagttacagtacccctccgacgttcggccaagggaccaaggtggaaatcaaac

SEQ ID NO: 178 - protein, 107 aa, Homo sapien
EIVLTQSPSSLSASVGDRVTITCRASQSISSYLNWYQQKPGKAPKLLIYAASTLQSGVPSRFSGSGSGTDFTLTISSLQPEDFATYYCQQSYSTPPTFGQGTKVEIK

SEQ ID NO: 179 - DNA, 364 bp, Homo sapien
gaagttcaattgttagagtctggtggcggtcttgttcagcctggtggttctttacgtctttcttgcgctgcttccggattcactttctctaagtacgatatgcattgggttcgccaagctcctggtaaaggtttggagtgggtttctgttatctctccttctggtggctggacttcttatgctgactccgttaaaggtcgcttcactatctctagagacaactctaagaatactctctacttgcagatgaacagcttaagggctgaggacaccgccatgtattactgtgcgagggatgactacagtaaaggacgggatgcttttgatatctggggccaagggacaatggtcaccgtctcaagcg

SEQ ID NO: 180 - protein, 121 aa, Homo sapien
EVQLLESGGGLVQPGGSLRLSCAASGFTFSKYDMHWVRQAPGKGLEWVSVISPSGGWTSYADSVKGRFTISRDNSKNTLYLQMNSLRAEDTAMYYCARDDYSKGRDAFDIWGQGTMVTVSS

SEQ ID NO: 181 - DNA, 322 bp, Homo sapien
gacatcgtgatgacccagtctccatcctccctgtctgcatctgtaggagacagagtcaccatcacttgccgggcaagtcagagcattagcagctatttaaattggtattagcagaaaccagggaaagcccctaacctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctgacgttcggccaagggaccaaggtggaaatcaaac

SEQ ID NO: 182 - protein, 107 aa, Homo sapien
DIVMTQSPSSLSASVGDRVTITCRASQSISSYLNWYQQKPGKAPNLLIYAASSLQSGVPSRFSGSGSGTDFTLTISSLQPEDFATYYCQQSYSTPLTFGQGTKVEIK

SEQ ID NO: 183 - DNA, 364 bp, Homo sapien
gaagttcaattgttagagtctggtggcggtcttgttcagcctggtggttctttacgtctttcttgcgccgcttccggattcactttctctaagtacgatatgcattgggttcgccaagctcctggtaaaggtttggagtgggtttctgttatctctccttctggtggctggacttcttatgctgactccgttaaaggtcgcttcactatctctagagacaactctaagaatactctctacttgcagatgaacagcttaagggctgaggacaccgccatgtattactgtgcgagggatgactacagtaaaggacgggatgcttttgatatctggggccaagggacaatggtcaccgtctcaagcg

SEQ ID NO: 184 - protein, 121 aa, Homo sapien; identical to SEQ ID NO: 180

SEQ ID NO: 185 - DNA, 322 bp, Homo sapien
gacatcgtgatgacccagtctccatcttctgtgtctgcatctgtaggagacagagtcaccatcacttgtcgggcgagtcagggtattagcagctatttaaattggtattagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactattgtcaacagagttacagtaccccaatcactttcggcggagggaccaaggtggagatcaaac

SEQ ID NO: 186 - protein, 107 aa, Homo sapien
DIVMTQSPSSVSASVGDRVTITCRASQGISSYLNWYQQKPGKAPKLLIYAASSLQSGVPSRFSGSGSGTDFTLTISSLQPEDFATYYCQQSYSTPITFGGGTKVEIK

SEQ ID NO: 187 - DNA, 364 bp, Homo sapien; identical to SEQ ID NO: 175

SEQ ID NO: 188 - protein, 121 aa, Homo sapien; identical to SEQ ID NO: 176

SEQ ID NO: 189 - DNA, 322 bp, Homo sapien
gaaacgacactcacgcagtctccatcctccctgtctgcatctgtaggagacagagtcaccatcacttgccgggcaagtcagagcattagcagctatttaaattggtattagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcggacgttcggccaagggaccaaggtggaaatcaagc

SEQ ID NO: 190 - protein, 107 aa, Homo sapien
ETTLTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIK

SEQ ID NO: 191 - DNA, 364 bp, Homo sapien; identical to SEQ ID NO: 175

SEQ ID NO: 192 - protein, 121 aa, Homo sapien; identical to SEQ ID NO: 176

SEQ ID NO: 193 - DNA, 322 bp, Homo sapien
gaaatagtgatgacgcagtctccatcctccctgtctgcatctgtaggagacagagtcaccatcacttgccgggcaagtcagagcattagcagctatttaaattggtattagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccccctcactttcggcggagggaccaaggtggaaatcaaac

SEQ ID NO: 194 - protein, 107 aa, Homo sapien
EIVMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 195 - DNA, 364 bp, Homo sapien; identical to SEQ ID NO: 167

SEQ ID NO: 196 - protein, 121 aa, Homo sapien; identical to SEQ ID NO: 168

SEQ ID NO: 197 - DNA, 322 bp, Homo sapien
gccatccagatgacccagtctccatcctccctgtctgcatctgtaggagacagagtcaccatcacttgccgggcaagtcagagcattagcagctatttaaattggtattagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccccctcactttcggcggagggaccaaggtggaaatcaaac

SEQ ID NO: 198 - protein, 107 aa, Homo sapien; identical to SEQ ID NO: 174

SEQ ID NO: 199 - DNA, 364 bp, Homo sapien
gaagttcaattgttagagtctggtggcggtcttgttcagcctggtggttctttacgtctttcttgcgctgcttccggattcactttctctaagtacgatatgcattgggttcgccaagctcccggtaaaggtttggagtgggtttctgttatctctccttctggtggctggacttcttatgctgactccgttaaaggtcgcttcactatctctagagacaactctaagaatactctctacttgcagatgaacagcctaagggctgaggacaccgccatgtattactgtgcgagggatgactacagtaaaggacgggatgcttttgatatctggggccaagggaccacggtcaccgtctcaagcg

SEQ ID NO: 200 - protein, 121 aa, Homo sapien; identical to SEQ ID NO: 168

SEQ ID NO: 201 - DNA, 322 bp, Homo sapien
gccatccagttgacccagtctccatcctccctgtctgcatctgtaggagacagagtcaccatcacttgccgggcaagtcagagcattagcagctatttaaattggtattagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccccctcactttcggcggagggaccaaagtggatatcaaac

SEQ ID NO: 202 - protein, 107 aa, Homo sapien
AIQLTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVDIK

SEQ ID NO: 203 - DNA, 364 bp, Homo sapien
gaagttcaattgttagagtctggtggcggtcttgttcagcctggtggttctttacgtctttcttgcgctgcttccggattcactttctctaagtacgatatgcattgggttcgccaagctcctggtaaaggtttggagtgggtttctgttatctctccttctggtggctggacttcttatgccgactccgttaaaggtcgcttcactatctctagagacaactctaagaatactctctacttgcagatgaacagcttaagggctgaggacaccgccatgtattactgtgcgagggatgactacagtaaaggacgggatgcttttgatatctggggccaagggaccacggtcaccgtctcaagcg

SEQ ID NO: 204 - protein, 121 aa, Homo sapien; identical to SEQ ID NO: 168

SEQ ID NO: 205 - DNA, 322 bp, Homo sapien
gatgttgtgatgactcagtctccactctccccgtctgcatctgtgggagacagagtcgccatcacttgccgcgcaagtcagagcatcgacacctatttaaattggtatcagcagaaaccagggacagcccctaagctcctgatctatgctgcatccagtttgcaaagtggggtcccatcaaggttcagtggcagtggatctgggacagatttcactctcaccatcagcagtctgcaacctgaggattttgcaacttactactgtcaacagagttacagtaccccgatcaccttcggccaagggacacgactggagcttagac

SEQ ID NO: 206 - protein, 107 aa, Homo sapien
DVVMTQSPLSPSASVGDRVAITCRASQSIDTYLNWYQQKPGTAPKLLIYAASSLQSGVPSRFSGSGSGTDFTLTISSLQPEDFATYYCQQSYSTPITFGQGTRLELR

SEQ ID NO: 207 - DNA, 364 bp, Homo sapien; identical to SEQ ID NO: 179

SEQ ID NO: 208 - protein, 121 aa, Homo sapien; identical to SEQ ID NO: 180

SEQ ID NO: 209 - DNA, 322 bp, Homo sapien
gccatctggatgacccagtctccatcctccctgtctgcatctgtaggagacagagtcaccatcacttgccgggcaagtcagagcattagcagctatttaaattggtattagcagaaaccagggaaagcccctaagctcctgatctatgctgcatccaagttggaagacggggtcccatcaagattcagtggcagtggagctgggacagatttcactctcaccatcagcagactggagcctgaagattttgcaacttactactgtcaacagagttacagtaccccgctcactttcggcggagggaccaaggtggaaatcaaac

SEQ ID NO: 210 - protein, 107 aa, Homo sapien
AIWMTQSPSSLSASVGDRVTITCRASQSISSYLNWYQQKPGKAPKLLIYAASKLEDGVPSRFSGSGAGTDFTLTISRLEPEDFATYYCQQSYSTPLTFGGGTKVEIK

SEQ ID NO: 211 - DNA, 364 bp, Homo sapien
gaagttcaattgttagagtctggtggcggtcttgttcagcctggtggttctttacgtctttcttgcgctgcttccggactcactttctctaagtacgatatgcattgggttcgccaagctcctggtaaaggtttggagtgggtttctgttatctctccttctggtggctggacttcttatgctgactccgttaaaggtcgcttcactatctctagagacaactctaagaatactctctacttgcagatgaacagcttaagggctgaggacaccgccatgtattactgtgcgagggatgactacagtaaaggacgggatgcttttgatatctggggccaagggaccacggtcaccgtctcaagcg

SEQ ID NO: 212 - protein, 121 aa, Homo sapien
EVQLLESGGGLVQPGGSLRLSCAASGLTFSKYDMHWVRQAPGKGLEWVSVISPSGGWTSYADSVKGRFTISRDNSKNTLYLQMNSLRAEDTAMYYCARDDYSKGRDAFDIWGQGTTVTVSS

SEQ ID NO: 213 - DNA, 331 bp, Homo sapien
cagcctgtgctgactcagccaccctcagcgtctgggacccccgggcagagggtcaccatctcttgttctggaagcagctccaacatcggaagcaatactgtgaactggtaccagcagctcccaggaatgccccccaaggtcctcatctctggtaataatcagcggccccccggggtccctggccgattctctggctccaagtctggcacctcagcctccctggccatcagtggcctccagtctgaggatgaggctgattatcactgtacagcctgggatgacaacctgaatggtccggtattcggcggaggcacccagctgaccgtcctcg

SEQ ID NO: 214 - protein, 110 aa, Homo sapien
QPVLTQPPSASGTPGQRVTISCSGSSSNIGSNTVNWYQQLPGMPPKVLISGNNQRPPGVPGRFSGSKSGTSASLAISGLQSEDEADYHCTAWDDNLNGPVFGGGTQLTVL

SEQ ID NO: 215 - DNA, 364 bp, Homo sapien
gaagttcaattgttagagtctggtggcggtcttgttcagcctggtggttctttacgtctttcttgcgctgcttccggattcactttctctgattaccttatggtttgggttcgccaagctcctggtaaaggtttggagtgggtttcttatatctctccttctggtggctggactgcttatgctgactccgttaaaggtcgcttcactatctctagagacaactctaagaatactctctacttgcagatgaacagcttaagggctgaggacactgcagtctactattgtgcgagagtggtggaactacgggccggcgacgcttttgatatctggggccaaggcaccctggtcaccgtctcaagcg

SEQ ID NO: 216 - protein, 121 aa, Homo sapien
EVQLLESGGGLVQPGGSLRLSCAASGFTFSDYLMVWVRQAPGKGLEWVSYISPSGGWTAYADSVKGRFTISRDNSKNTLYLQMNSLRAEDTAVYYCARVVELRAGDAFDIWGQGTLVTVSS

SEQ ID NO: 217 - DNA, 322 bp, Homo sapien
gccatccggatgacccagtctccatcctccctgtctgcatctgtaggagacagagtcaccatcacttgccgggcaagtcagagcattagcagctatttaaattggtattagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccgctcactttcggcggagggaccaaggtggagatcaaac

SEQ ID NO: 218 - protein, 107 aa, Homo sapien
AIRMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 219 - DNA, 364 bp, Homo sapien; identical to SEQ ID NO: 179

SEQ ID NO: 220 - protein, 121 aa, Homo sapien; identical to SEQ ID NO: 180

SEQ ID NO: 221 - DNA, 322 bp, Homo sapien
aacatccagatgacccagtctccatcctccctgtctgcatctgtaggagacagagtcaccatcacttgccgggcaagtcagaccattagcacctatttaaattggtatcagcagaaaccagggaaagcccctaagctcctgatctatggtgcatccagtttgcaaagtggggtcccatcaaggttcagtggcagtggatctgggacagatttcactctcaccatcagcagtctgcaacctgaagattttgcaacttactactgtcaacagagttacagtacccccgtgacgttcggccaagggaccaaggtggaaatcaagc

SEQ ID NO: 222 - protein, 107 aa, Homo sapien
NIQMTQSPSSLSASVGDRVTITCRASQTISTYLNWYQQKPGKAPKLLIYGASSLQSGVPSRFSGSGSGTDFTLTISSLQPEDFATYYCQQSYSTPVTFGQGTKVEIK

SEQ ID NO: 223 - DNA, 364 bp, Homo sapien; identical to SEQ ID NO: 175

SEQ ID NO: 224 - protein, 121 aa, Homo sapien; identical to SEQ ID NO: 176

SEQ ID NO: 225 - DNA, 322 bp, Homo sapien
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcggacgttcggccaagggaccaaggtggaaatcaaac

SEQ ID NO: 226 - protein, 107 aa, Homo sapien
DIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIK

SEQ ID NO: 227 - DNA, 364 bp, Homo sapien
gaagttcaattgttagagtctggtggcggtcttgttcagcctggtggttctttacgtctttcttgcgctgcttccggattcactttctctcgttacgatatggagtgggttcgccaagctcctggtaaaggtttggagtgggtttcttctatctctccttctggtggctggacttcttatgctgactccgttaaaggtcgcttcactatctctagagacaactctaagaatactctctacttgcagatgaacagcttaagggctgaggacacggccgtgtattactgtgcgagagatcatagtggctacgattctgaatactttgactactggggccagggaaccctggtcaccgtctcaagcg

SEQ ID NO: 228 - protein, 121 aa, Homo sapien
EVQLLESGGGLVQPGGSLRLSCAASGFTFSRYDMEWVRQAPGKGLEWVSSISPSGGWTSYADSVKGRFTISRDNSKNTLYLQMNSLRAEDTAVYYCARDHSGYDSEYFDYWGQGTLVTVSS

SEQ ID NO: 229 - DNA, 319 bp, Homo sapien
gacatcgtgatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccaatttgcaaagtggggtcccatcaaggttcagtggcagtggatctgggacagatttcactctcaccatcagtagtctgcaacgtgaagattttgcaacttactactgtcaacagagttacagtgccccgacgttcggccaagggaccaaggtggaaatcaagc

SEQ ID NO: 230 - protein, 106 aa, Homo sapien
DIVMTQSPSSLSASVGDRVTITCRASQSISSYLNWYQQKPGKAPKLLIYAASNLQSGVPSRFSGSGSGTDFTLTISSLQREDFATYYCQQSYSAPTFGQGTKVEIK

SEQ ID NO: 231 - DNA, 364 bp, Homo sapien
gaagttcaattgttagaatctggtggcggtcttgttcagcctggtggttctttacgtctttcttgcgctgcttccggattcactttctctaagtacgatatgcattgggttcgccaagctcctggtaaaggtttggagtgggtttctgttatctctccttctggtggctggacttcttatgctgactccgttaaaggtcgcttcactatctctagagacaactctaagaatactctctacttgcagatgaacagcttaagggctgaggacaccgccatgtattactgtgcgagggatgactacagtaaaggacgggatgcttttgatatctggggccaagggacaatggtcaccgtctcaagcg

SEQ ID NO: 232 - protein, 121 aa, Homo sapien; identical to SEQ ID NO: 180

SEQ ID NO: 233 - DNA, 331 bp, Homo sapien
cagtctgtgctgacgcagccgccctcagcgtctgggacccccgggcagagggtcaccatctcttgttctggaagcagctccaacatcggaagcaatcctgttaactggtaccagcaactcccaggaacggcccccaaactcctcatctatagtaataggcagcggccctcaggggtccctgaccgattctctggctccaggtctggcacctcaggctccctggccatcagtggactccagtctgaggatgaggcggattactactgtgcaacatgggatgacagcctgaatggttgggtgttcggcggaggcacccagctgaccgtcctcg

SEQ ID NO: 234 - protein, 110 aa, Homo sapien
QSVLTQPPSASGTPGQRVTISCSGSSSNIGSNPVNWYQQLPGTAPKLLIYSNRQRPSGVPDRFSGSRSGTSGSLAISGLQSEDEADYYCATWDDSLNGWVFGGGTQLTVL

SEQ ID NO: 235 - DNA, 340 bp, Homo sapien; identical to SEQ ID NO: 171

SEQ ID NO: 236 - protein, 113 aa, Homo sapien; identical to SEQ ID NO: 172

SEQ ID NO: 237 - DNA, 322 bp, Homo sapien
gatgttgtgatgactcagtctccactctccctgtctgcatctgtaggagacagagtcaccatcacttgccgggcaagtcagaccattagcaggtatttaaattggtatcagcagaaaccagggacagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccaacgttcggccaagggaccaaggtggaaatcaaac

SEQ ID NO: 238 - protein, 107 aa, Homo sapien
DVVMTQSPLSLSASVGDRVTITCRASQTISRYLNWYQQKPGTAPKLLIYAASSLQSGVPSRFSGSGSGTDFTLTISSLQPEDFATYYCQQSYSTPPTFGQGTKVEIK

SEQ ID NO: 239 - DNA, 364 bp, Homo sapien; identical to SEQ ID NO: 179

SEQ ID NO: 240 - protein, 121 aa, Homo sapien; identical to SEQ ID NO: 180

SEQ ID NO: 241 - DNA, 322 bp, Homo sapien
gccatccagatgacccagtctccatcctccctgtctgcatctgtaggagacagagtcaccatcacttgccgggcaagtcagagcattagcagctatttaaattggtatcagcagaaaccagggaaagcccctaaactcctgatccatgctgcatccaatttgcagagtggggtcccatcaaggttcagtggcagtggatctgggacagatttcactctcaccatcagcagtctgcaacctgaagattttgcaacttactactgtcaacagagttacagtacccctctcactttcggcggagggaccaaggtggagatcaagc

SEQ ID NO: 242 - protein, 107 aa, Homo sapien
AIQMTQSPSSLSASVGDRVTITCRASQSISSYLNWYQQKPGKAPKLLIHAASNLQSGVPSRFSGSGSGTDFTLTISSLQPEDFATYYCQQSYSTPLTFGGGTKVEIK

SEQ ID NO: 243 - DNA, 355 bp, Homo sapien
gaagttcaattgttagagtctggtggcggtcttgttcagcctggtggttctttacgtctttcttgcgctgcttccggattcactttctctcattacgagatgggttgggttcgccaagctcctggtaaaggtttggagtgggtttcttatatctcttcttctggtggctggactgcttatgctgactccgttaaaggtcgcttcactatctctagagacaactctaagaatactctctacttgcagatgaacagcttaagggctgaggacacggccgtgtattactgtgcaaggattggctacgcagatgcttttgatatctggggccaagggaccacggtcaccgtctcaagcg

SEQ ID NO: 244 - protein, 118 aa, Homo sapien
EVQLLESGGGLVQPGGSLRLSCAASGFTFSHYEMGWVRQAPGKGLEWVSYISSSGGWTAYADSVKGRFTISRDNSKNTLYLQMNSLRAEDTAVYYCARIGYADAFDIWGQGTTVTVSS

SEQ ID NO: 245 - DNA, 331 bp, Homo sapien
cagagcgaattgactcagccaccctcagcgtctgggacccccgggcagagggtcaccatctcttgttctggaagcagctccaacatcggaaggaatcctgtaaactggtaccagcacctcccaggaacggcccccaaactcctcatctatggtgataatcagcggccctcaggggtccctgaccgattctctggctccaggtctggcacctcagcctccctggccatcagtgggctccagtctgaggatgaggctgattattactgtgcagcatgggatgacagcctgaatggtgtggtattcggcggagggaccaagctgaccgtcctag

SEQ ID NO: 246 - protein, 110 aa, Homo sapien
QSELTQPPSASGTPGQRVTISCSGSSSNIGRNPVNWYQHLPGTAPKLLIYGDNQRPSGVPDRFSGSRSGTSASLAISGLQSEDEADYYCAAWDDSLNGVVFGGGTKLTVL

SEQ ID NO: 247 - DNA, 340 bp, Homo sapien
gaagttcaattgttagagtctggtggcggtcttgttcagcctggtggttctttacgtctttcttgcgctgcttccggattcactttctctggttacattatgtggtgggttcgccaagctcctggtaaaggtttggagtgggtttctgttatctctccttctggtggcgatacttggtatgctgactccgttaaaggtcgcttcactatctctagagacaactctaagaatactctctacttacagatgaacagcttaagggctgaggacacggccgtgtattactgtgccacagcgggagactactggggccagggcaccctggtcaccgtctcaagcg

SEQ ID NO: 248 - protein, 113 aa, Homo sapien; identical to SEQ ID NO: 172

SEQ ID NO: 249 - DNA, 322 bp, Homo sapien
gccatccagatgacccagtctccagactccctgtctgcatctgtaggagacagagtcaccatcacttgccgggcaagtcagagtattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcggacgttcggccaagggaccaaggtggaaatcaaac

SEQ ID NO: 250 - protein, 107 aa, Homo sapien
AIQMTQSPDSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIK

SEQ ID NO: 251 - DNA, 364 bp, Homo sapien
gaagttcaattgttagggtctggtggcggtcttgttcagcctggtggttctttacgtctttcttgcgctgcttccggattcactttctctcgttacgatatggagtgggttcgccaagctcctggtaaaggtttggagtgggtttcttctatctctccttctggtggctggacttcttatgctgactccgttaaaggtcgcttcactatctctagagacaactctaagaatactctctacttgcagatgaacagcttaagggctgaggacacggccgtgtattactgtgcgagagatcatagtggctacgattctgaatactttgactactggggccaggggaccctggtcaccgtctcaagcg

SEQ ID NO: 252 - protein, 121 aa, Homo sapien
EVQLLGSGGGLVQPGGSLRLSCAASGFTFSRYDMEWVRQAPGKGLEWVSSISPSGGWTSYADSVKGRFTISRDNSKNTLYLQMNSLRAEDTAVYYCARDHSGYDSEYFDYWGQGTLVTVSS

SEQ ID NO: 253 - DNA, 319 bp, Homo sapien
gacatcgtgatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtgccccgacgttcggccaagggaccaaggtggaaatcaagc

SEQ ID NO: 254 - protein, 106 aa, Homo sapien
DIVMTQSPSSLSASVGDRVTITCRASQSISSYLNWYQQKPGKAPKLLIYAASSLQSGVPSRFSGSGSGTDFTLTISSLQPEDFATYYCQQSYSAPTFGQGTKVEIK

SEQ ID NO: 255 - DNA, 364 bp, Homo sapien; identical to SEQ ID NO: 175

SEQ ID NO: 256 - protein, 121 aa, Homo sapien; identical to SEQ ID NO: 176

SEQ ID NO: 257 - DNA, 322 bp, Homo sapien
gccatccggatgacccagtctccatcctccctgtctgcatctgtaggagacagagtcaccatcacttgccgggcaagtcagagcattagcagctatttaaattggtattagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccccctcactttcggcggagggaccaagctgaccgtcctag

SEQ ID NO: 258 - protein, 107 aa, Homo sapien
AIRMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKLTVL

SEQ ID NO: 259 - DNA, 364 bp, Homo sapien
gaagttcaattgttagagtctggtggcggtcttgttcagcctggtggttctttacgtctttcttgcgctgcttccggattcactttctctaagtacgatatgcattgggttcgccaagctcctggtaaaggtttggagtgggtttctgttatctctccttctggtggctggacttcttatgctgactccgttaaaggtcgcttcactatctctagagacaactctaagaatactctctacttgcagatgaacagcttaagggctgaggacaccgccatgtattactgtgcgagggatggctacagtaaaggacgggatgcttttgatatctggggccaaggcaccctggtcaccgtctcaagcg

SEQ ID NO: 260 - protein, 121 aa, Homo sapien
EVQLLESGGGLVQPGGSLRLSCAASGFTFSKYDMHWVRQAPGKGLEWVSVISPSGGWTSYADSVKGRFTISRDNSKNTLYLQMNSLRAEDTAMYYCARDGYSKGRDAFDIWGQGTLVTVSS

SEQ ID NO: 261 - DNA, 322 bp, Homo sapien
gacatccagttgacccagtctccatcctccctgtctgcatctctgggagacagagtcaccatcacttgccgggcaagtgagagtattaggggctatttaaattggtatcagcagaaaccagggaaagcccctaagctcctgatctatgctgcctccagtttgcaaagtggggtcccatcaaggttcagtggcagtggatctgggacagatttcactctcaccatcagcagtctgcaacctgaagattttgcaacttacttctgtcaacagagttacagtaccccttacacttttggccaggggaccaagctggagatcaaac

SEQ ID NO: 262 - protein, 107 aa, Homo sapien
DIQLTQSPSSLSASLGDRVTITCRASESIRGYLNWYQQKPGKAPKLLIYAASSLQSGVPSRFSGSGSGTDFTLTISSLQPEDFATYFCQQSYSTPYTFGQGTKLEIK

SEQ ID NO: 263 - DNA, 364 bp, Homo sapien
gaagttcaattgttagagtctggtggcggtcttgttcagcctggtggttctttacgtctttcttgcgctgcttccggattcactttctctaagtacgatatgcattgggttcgccaagctcctggtaaaggtttggagtgggtttctgttatctctccttctggtggctgaacttcttatgctgactccgttaaaggtcgcttcactatctctagagacaactctaagaatactctctacttgcagatgaacagcttaagggctgaggacaccgccatgtattactgtgcgagggatgactacagtaaaggacgggatgcttttgatatctggggccaagggaccctggtcaccgtctcaagcg

SEQ ID NO: 264 - protein, 121 aa, Homo sapien; identical to SEQ ID NO: 176

SEQ ID NO: 265 - DNA, 322 bp, Homo sapien
gccatccagttgacccagtctccatcttctgtgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccgctcactttcggcggagggaccaagctggagatcaaac

SEQ ID NO: 266 - protein, 107 aa, Homo sapien
AIQLTQSPSSVSASVGDRVTITCRASQSISSYLNWYQQKPGKAPKLLIYAASSLQSGVPSRFSGSGSGTDFTLTISSLQPEDFATYYCQQSYSTPLTFGGGTKLEIK

SEQ ID NO: 267 - DNA, 364 bp, Homo sapien; identical to SEQ ID NO: 175

SEQ ID NO: 268 - protein, 121 aa, Homo sapien; identical to SEQ ID NO: 176

SEQ ID NO: 269 - DNA, 322 bp, Homo sapien
gatgttgtgatgacacagtctccatcctccctgtctgcatctgtaggagacagagtcaccatcacttgccgggcaagtcagagcattagcagctatttaaattggtattagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccccctcactttcggcggagggaccaagctggagatcaaac

SEQ ID NO: 270 - protein, 107 aa, Homo sapien
DVVMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKLEIK

SEQ ID NO: 271 - DNA, 364 bp, Homo sapien; identical to SEQ ID NO: 179

SEQ ID NO: 272 - protein, 121 aa, Homo sapien; identical to SEQ ID NO: 180

SEQ ID NO: 273 - DNA, 331 bp, Homo sapien
cagtctgtgctgacgcagccgccctcagcgtctgggacccccgggcagagggtcaccatctcttgttctggaagcagctccaacatcggaagtaataatgtcaactggtaccagcaactcccaggaacggcccccaaactcctcatctacagtaatgatcagcggccctcaggggtccctgaccgattctctggctccaggtctggcacctcaggctccctggccatcagtggactccagtctgaggatgaggcggattactactgtgcaacatgggatgacagcctgaatggttgggtgttcggcggagggaccaagctgaccgtcctag

SEQ ID NO: 274 - protein, 110 aa, Homo sapien
QSVLTQPPSASGTPGQRVTISCSGSSSNIGSNNVNWYQQLPGTAPKLLIYSNDQRPSGVPDRFSGSRSGTSGSLAISGLQSEDEADYYCATWDDSLNGWVFGGGTKLTVL

SEQ ID NO: 275 - DNA, 340 bp, Homo sapien
gaagttcaattgttagagtctggtggcggtcttgttcagcctggtggttctttacgtctttcttgcgctgcttccggattcactttctctggttacattatgtggtgggttcgccaagctcctggtaaaggtttggagtgggtttctgttatctctccttctggtggcgatacttggtatgctgactccgttaaaggtcgcttcactatctctagagacaactctaagaatactctctacttgcagatgaacagcttaagggctgaggacacggccgtgtattactgtgccacagcgggagactactggggccagggcaccctggtcactgtctcaagcg

SEQ ID NO: 276 - protein, 113 aa, Homo sapien; identical to SEQ ID NO: 172

SEQ ID NO: 277 - DNA, 322 bp, Homo sapien
aacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccgtacacttttggccaggggaccaagctggagatcaaac

SEQ ID NO: 278 - protein, 107 aa, Homo sapien
NIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIK

SEQ ID NO: 279 - DNA, 364 bp, Homo sapien
gaagttcaattgttagagtctggtggcggtcttgttcagcctggtggttctttacgtctttcttgcgctgcttccggattcactttctcttggtacgatatggtttgggttcgccaagctcctggtaaaggtttggagtgggtttctgttatctctccttctggtggctggacttcttatgctgactccgttaaaggtcgcttcactatctctagagacaactctaagaatactctctacttgcagatgaacagcttaagggctgaggacacggccgtgtattactgtgcgagagatcatagtggctacgattctgaatactttgactactggggccagggcaccctggtcaccgtctcaagcg

SEQ ID NO: 280 - protein, 121 aa, Homo sapien
EVQLLESGGGLVQPGGSLRLSCAASGFTFSWYDMVWVRQAPGKGLEWVSVISPSGGWTSYADSVKGRFTISRDNSKNTLYLQMNSLRAEDTAVYYCARDHSGYDSEYFDYWGQGTLVTVSS

SEQ ID NO: 281 - DNA, 322 bp, Homo sapien
gaaatagtgatgacgcagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacctactactgtcaacagagttacagtacccctctcactttcggccctgggaccaaagtggatatcaaac

SEQ ID NO: 282 - protein, 107 aa, Homo sapien
EIVMTQSPSSLSASVGDRVTITCRASQSISSYLNWYQQKPGKAPKLLIYAASSLQSGVPSRFSGSGSGTDFTLTISSLQPEDFATYYCQQSYSTPLTFGPGTKVDIK

SEQ ID NO: 283 - DNA, 355 bp, Homo sapien
gaagttcaattgttagagtctggtggcggtcttgttcagcctggtggttctttacgtctttcttgcgctgcttccggattcactttctctcattacgagatgggttgggttcgccaagctcctggtaaaggtttggagtgggtttcttatatctctccttctggtggctggactgcttatgctgactccgttaaaggtcgcttcactatctctagagacaactctaagaatactctctacttgcagatgaacagcttaagggctgaggacacggccgtgtattactgtgcaaggattgactacgcagatgcttttgatatctggggccaagggaccctggtcaccgtctcaagcg

SEQ ID NO: 284 - protein, 118 aa, Homo sapien
EVQLLESGGGLVQPGGSLRLSCAASGFTFSHYEMGWVRQAPGKGLEWVSYISPSGGWTAYADSVKGRFTISRDNSKNTLYLQMNSLRAEDTAVYYCARIDYADAFDIWGQGTLVTVSS

SEQ ID NO: 285 - DNA, 331 bp, Homo sapien
cagtctgtgttgactcagccaccctcagcatctgagacccccgggcagagggtcaccatctcttgttctggagtcagctccaacatcggaaggaattctgttacctggtaccagcagctcccaggaacggcccccaaactcctcatctataggaataatcagcggccctcaggggtccctgaccgattctctggctccaagtctggcacctcagcctccctggccatcagtgggctccggtccgaggatgaggctgattattactgtgcaacatgggatgacagcctgagtggttgggtgttcggcggagggaccaagctgaccgtcctag

SEQ ID NO: 286 - protein, 110 aa, Homo sapien
QSVLTQPPSASETPGQRVTISCSGVSSNIGRNSVTWYQQLPGTAPKLLIYRNNQRPSGVPDRFSGSKSGTSASLAISGLRSEDEADYYCATWDDSLSGWVFGGGTKLTVL

SEQ ID NO: 287 - DNA, 340 bp, Homo sapien
gaagttcaattgttagagtctggtggcggtcttgttcagcctggtggttctttacgtctttcttgcgctgcttccggattcactttctctggttacattatgtggtgggttcgccaagctcctggtaaaggtttggagtgggtttctgttatctctccttctggtggcgatacttggtatgctgactccgttaaaggtcgcttcactatctctagagacaactctaagaatactctctacttgcagatgaacagcttaagggctgaggacacggccgtgtattactgtgccacagcgggagactactggggccaggggaccctggtcaccgtctcaagcg

SEQ ID NO: 288 - protein, 113 aa, Homo sapien; identical to SEQ ID NO: 172

SEQ ID NO: 289 - DNA, 322 bp, Homo sapien
gccatccggatgacacagtctccgtcctccctgtctgcatctgtaggagacagagtcaccatcacttgccgggcaagtcagagcattagcagctatttaaattggtattagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccccctcactttcggcggagggaccaagctggagatcaaac

SEQ ID NO: 290 - protein, 107 aa, Homo sapien
AIRMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKLEIK

SEQ ID NO: 291 - DNA, 364 bp, Homo sapien; identical to SEQ ID NO: 179

SEQ ID NO: 292 - protein, 121 aa, Homo sapien; identical to SEQ ID NO: 180

SEQ ID NO: 293 - DNA, 322 bp, Homo sapien
aacatccagatgacccagtctccatcctccctgtctgcatctgtaggagacagagtcaccatcacttgccgggcaagtcagagcattagcagctatttaaattggtactagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccccctcactttcggcggagggaccaaggtggagatcaaac

SEQ ID NO: 294 - protein, 107 aa, Homo sapien
NIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 295 - DNA, 364 bp, Homo sapien
gaagttcaattgctagagtctggtggcggtcttgttcagcctggtggttctttacgtctttcttgcgctgcttccggattcactttctctaagtacgatatgcattgggttcgccaagctcctggtaaaggtttggagtgggtttctgttatctctccttctggtggctggacttcttatgctgactccgttaaaggtcgcttcactatctctagagacaactctaagaatactctctacttgcagatgaacagcttaagggctgaggacaccgccatgtattactgtgcgagggatgactacagtaaaggacgggatgcttttgatatctggggccaagggaccacggtcaccgtctcaagcg

SEQ ID NO: 296 - protein, 121 aa, Homo sapien; identical to SEQ ID NO: 168

SEQ ID NO: 297 - DNA, 319 bp, Homo sapien
gccatccggatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtgccccgacgttcggccaagggaccaaggtgggaatcaagc

SEQ ID NO: 298 - protein, 106 aa, Homo sapien
AIRMTQSPSSLSASVGDRVTITCRASQSISSYLNWYQQKPGKAPKLLIYAASSLQSGVPSRFSGSGSGTDFTLTISSLQPEDFATYYCQQSYSAPTFGQGTKVGIK

SEQ ID NO: 299 - DNA, 364 bp, Homo sapien; identical to SEQ ID NO: 179

SEQ ID NO: 300 - protein, 121 aa, Homo sapien; identical to SEQ ID NO: 180

SEQ ID NO: 301 - DNA, 331 bp, Homo sapien
cagagcgaattgactcagccaccctcagcgtctgggacccccgggcagagggtcaccatctcttgttctggaagcagctccaacatcggaagcaatcctgttaactggtaccagcaactcccaggaacggcccccaaactcctcatctatagtaataggcagcggccctcaggggtccctgaccgattctctggctccaggtctggcacctcaggctccctggccatcagtggactccagtctgaggatgaggcggattactactgtgcaacatgggatgacagcctgaatggttgggtgttcggcggaggcacccagctgaccgtcctcg

SEQ ID NO: 302 - protein, 110 aa, Homo sapien
QSELTQPPSASGTPGQRVTISCSGSSSNIGSNPVNWYQQLPGTAPKLLIYSNRQRPSGVPDRFSGSRSGTSGSLAISGLQSEDEADYYCATWDDSLNGWVFGGGTQLTVL

SEQ ID NO: 303 - DNA, 340 bp, Homo sapien; identical to SEQ ID NO: 171

SEQ ID NO: 304 - protein, 113 aa, Homo sapien; identical to SEQ ID NO: 172

SEQ ID NO: 305 - DNA, 322 bp, Homo sapien
gacatccagttgacccagtctccatcttccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccgtacacttttggccaggggaccaagctggagatcaaac

SEQ ID NO: 306 - protein, 107 aa, Homo sapien
DIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIK

SEQ ID NO: 307 - DNA, 364 bp, Homo sapien; identical to SEQ ID NO: 175

SEQ ID NO: 308 - protein, 121 aa, Homo sapien; identical to SEQ ID NO: 176

SEQ ID NO: 309 - DNA, 331 bp, Homo sapien
cagagcgaattgactcagccaccctcagcgtctgggacccccgggcagggggtcaccatctcttgttctggaagtagttccaacatcggaagtaatactgttcagtggtaccagcagttcccaggaagggcccccaaactcctcatctatagtaataatcggcggccctcaggggtccctgaccgattctctggttccaagtctggcacctcagcctccctggccatcagtgggctccggtccgaggattaggctgattattactgtgcagcatgggatgacagcctgagtgtcgtggtattcggcggagggaccaagctgaccgtcctag

SEQ ID NO: 310 - protein, 110 aa, Homo sapien
QSELTQPPSASGTPGQGVTISCSGSSSNIGSNTVQWYQQFPGRAPKLLIYSNNRRPSGVPDRFSGSKSGTSASLAISGLRSEDQADYYCAAWDDSLSVVVFGGGTKLTVL

SEQ ID NO: 311 - DNA, 340 bp, Homo sapien; identical to SEQ ID NO: 275

SEQ ID NO: 312 - protein, 113 aa, Homo sapien; identical to SEQ ID NO: 172

SEQ ID NO: 313 - DNA, 322 bp, Homo sapien
gccatctggatgacccagtctccatcctccctgtctgcatctgtaggagacagagtcaccatcacttgccggacaagtcagagcattagtaactatttaaattggtatcaacagaagccagggaaagccccaaagctcctgatctatgccagatccagtttgcaaagtggggtcccatcaaggttcagtggcagtggatctgggacagatttcactctcaccatcagcagtctgcaacctgaagattttgcaacttactactgtcaacagagttacagtaccccgatcaccttcggccaagggacacgactggagattaaac

SEQ ID NO: 314 - protein, 107 aa, Homo sapien
AIWMTQSPSSLSASVGDRVTITCRTSQSISNYLNWYQQKPGKAPKLLIYARSSLQSGVPSRFSGSGSGTDFTLTISSLQPEDFATYYCQQSYSTPITFGQGTRLEIK

SEQ ID NO: 315 - DNA, 364 bp, Homo sapien; identical to SEQ ID NO: 175

SEQ ID NO: 316 - protein, 121 aa, Homo sapien; identical to SEQ ID NO: 176

SEQ ID NO: 317 - DNA, 331 bp, Homo sapien
cagtctgtgttgactcagccaccctcagcgtctgggacccccgggcagagggtcaccatctcttgttctggaagcagctccaacatcggaagtaatattgtaaactggttccagcaactcccaggaacggcccccaaactcctcatctatagtgataatcagcggccctcaggggtccctgaccgattctctggctccaggtctggcacctcaggctccctggccatcagtggactccagtctgaggatgaggcggattactactgtgcaacatgggatgacagcctgaatggttgggtgttcggcggagggaccaagctgaccgtcctag

SEQ ID NO: 318 - protein, 110 aa, Homo sapien
QSVLTQPPSASGTPGQRVTISCSGSSSNIGSNIVNWFQQLPGTAPKLLIYSDNQRPSGVPDRFSGSRSGTSGSLAISGLQSEDEADYYCATWDDSLNGWVFGGGTKLTVL

SEQ ID NO: 319 - DNA, 340 bp, Homo sapien; identical to SEQ ID NO: 275

SEQ ID NO: 320 - protein, 113 aa, Homo sapien; identical to SEQ ID NO: 172

SEQ ID NO: 321 - DNA, 322 bp, Homo sapien
aacatccagatgacccagtctccatcctccctgtctgcatctgtaggagacagagtcaccatcacttgccgggcaagtcagagcattagcagctatttaaattggtatcagcagaaaccagggaaagcccctaaactcctgatctatgatgcatccagtttgcaaagtggggtcccattaaggttcagtggcagtggatctgggacagatttcactctcaccatcagcagtctgcaacctgaagattttgcaacttactactgtcaacagagttacagtaccccgctcactttcggcggagggaccaaagtggatatcaaac

SEQ ID NO: 322 - protein, 107 aa, Homo sapien
NIQMTQSPSSLSASVGDRVTITCRASQSISSYLNWYQQKPGKAPKLLIYDASSLQSGVPLRFSGSGSGTDFTLTISSLQPEDFATYYCQQSYSTPLTFGGGTKVDIK

SEQ ID NO: 323 - DNA, 367 bp, Homo sapien
gaagttcaattgttagagtctggtggcggtcttgttcagcctggtggttctttacgtctttcttgcgctgcttccggattcactttctcttggtacgatatggattgggttcgccaagctcctggtaaaggtttggagtgggtttctgttatctctccttctggtggctggactgcttatgctgactccgttaaaggtcgcttcactatctctagagacaactctaagaatactctctacttgcagatgaacagcttaagggctgaggacacggccgtgtattactgtgcgagagatagtagtggttattactcacctgatgcttttgatatctggggccaagggaccctggtcaccgtctcaagcg

SEQ ID NO: 324 - protein, 122 aa, Homo sapien
EVQLLESGGGLVQPGGSLRLSCAASGFTFSWYDMDWVRQAPGKGLEWVSVISPSGGWTAYADSVKGRFTISRDNSKNTLYLQMNSLRAEDTAVYYCARDSSGYYSPDAFDIWGQGTLVTVSS

SEQ ID NO: 325 - DNA, 322 bp, Homo sapien
gccatccagttgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagacttcactctcaccatcagcagtctgcaacctgaagattttgcagcttactactgtcaacagagttacacaacacctctgacgttcggccaagggaccaaggtggaaatcaaac

SEQ ID NO: 326 - protein, 107 aa, Homo sapien
AIQLTQSPSSLSASVGDRVTITCRASQSISSYLNWYQQKPGKAPKLLIYAASSLQSGVPSRFSGSGSGTDFTLTISSLQPEDFAAYYCQQSYTTPLTFGQGTKVEIK

SEQ ID NO: 327 - DNA, 364 bp, Homo sapien; identical to SEQ ID NO: 175

SEQ ID NO: 328 - protein, 121 aa, Homo sapien; identical to SEQ ID NO: 176

SEQ ID NO: 329 - DNA, 322 bp, Homo sapien
gccatctggatgacccagtctccatcctccctgtctgcatctgtcggagacagagtcaccattccttgccggtcaagtcagaacattaacaactttgtgaattggtatcaacagaaaccagggaaagcccctaaactcctgatctatgctgcatccagattgaaaggtggggtcccttcaaggttcagtggcagtggatctgggacagatttcactctcaccatcagcagtctgcaacctgaagattttgcaacttactactgtcaacagagttacagtacccctctcactttcggcggagggaccaagctggagatcaaac

SEQ ID NO: 330 - protein, 107 aa, Homo sapien
AIWMTQSPSSLSASVGDRVTIPCRSSQNINNFVNWYQQKPGKAPKLLIYAASRLKGGVPSRFSGSGSGTDFTLTISSLQPEDFATYYCQQSYSTPLTFGGGTKLEIK

SEQ ID NO: 331 - DNA, 340 bp, Homo sapien; identical to SEQ ID NO: 171

SEQ ID NO: 332 - protein, 113 aa, Homo sapien; identical to SEQ ID NO: 172

SEQ ID NO: 333 - DNA, 322 bp, Homo sapien
gatgttgtgatgacacagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccgctcactttcggcggagggaccaaggtggaaatcaaac

SEQ ID NO: 334 - protein, 107 aa, Homo sapien
DVVMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 335 - DNA, 355 bp, Homo sapien
gaagttcaattgttagagtctggtggcggtcttgttcagcctggtggttctttacgtctttcttgcgctgcttccggattcactttctctcgttacgagatgggttgggttcgccaagctcctggtaaaggtttggagtgggtttcttatatctctccttctggtggctggactgcttatgctgactccgttaaaggtcgcttcactatctctagagacaactctaagaatactctctacttgcagatgaacagcttaagggctgaggacacggccgtgtattactgtgcaaggattgactacgcagatgcttttgatatctggggccaagggacaatggtcaccgtctcaagcg

SEQ ID NO: 336 - protein, 118 aa, Homo sapien
EVQLLESGGGLVQPGGSLRLSCAASGFTFSRYEMGWVRQAPGKGLEWVSYISPSGGWTAYADSVKGRFTISRDNSKNTLYLQMNSLRAEDTAVYYCARIDYADAFDIWGQGTMVTVSS

SEQ ID NO: 337 - DNA, 331 bp, Homo sapien
cagtctgtgctgactcagccaccctcggtgtctgaagccccccggcagagggtcaccatctcctgttctggaagcagctccaacatcggcaaaaatgctgtacactggtaccagcagctcccaggcaaggctcccagactcctcatctattatgatgatttattgccctcaggggtctctgaccgattctctggctccaggtctggcacctcagcctccctggccatcagtgggctccggtccgaggatgaggctgattattactgtgcagcatgggatgacagcctgagtggttgggtgttcggcggagggaccaagctgaccgtcctag

SEQ ID NO: 338 - protein, 110 aa, Homo sapien
QSVLTQPPSVSEAPRQRVTISCSGSSSNIGKNAVHWYQQLPGKAPRLLIYYDDLLPSGVSDRFSGSRSGTSASLAISGLRSEDEADYYCAAWDDSLSGWVFGGGTKLTVL

SEQ ID NO: 339 - DNA, 340 bp, Homo sapien; identical to SEQ ID NO: 287

SEQ ID NO: 340 - protein, 113 aa, Homo sapien; identical to SEQ ID NO: 172

SEQ ID NO: 341 - DNA, 322 bp, Homo sapien
gaaattgtgctgactcagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcggtctgcaacctgaagattttgcaacctactactgtcaacagagttacagttccccccttactttcggcggagggaccaaggtggaaatcaaac

SEQ ID NO: 342 - protein, 107 aa, Homo sapien
EIVLTQSPSSLSASVGDRVTITCRASQSISSYLNWYQQKPGKAPKLLIYAASSLQSGVPSRFSGSGSGTDFTLTISGLQPEDFATYYCQQSYSSPLTFGGGTKVEIK

SEQ ID NO: 343 - DNA, 364 bp, Homo sapien; identical to SEQ ID NO: 263

SEQ ID NO: 344 - protein, 121 aa, Homo sapien; identical to SEQ ID NO: 176

SEQ ID NO: 345 - DNA, 322 bp, Homo sapien
gaaattgtaatgacgcagtctccatcctccctgtctgcatctgtaggagacagagtcaccatcacttgccgggcaagtcagagcattagcagctatttaaattggtattagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccccctcactttcggcggagggaccaaggtggaaatcaagc

SEQ ID NO: 346 - protein, 107 aa, Homo sapien; identical to SEQ ID NO: 194

SEQ ID NO: 347 - DNA, 355 bp, Homo sapien
gaagttcaattgttagagtctggtggcggtcttgttcagcctggtggttctttacgtctttcttgcgctgcttccggattcactttctctcattacgagatggcttgggttcgccaagctcctggtaaaggtttggagtgggtttcttatatctcttcttctggtggctggacttcttatgctgactccgttaaaggtcgcttcactatctctagagacaactctaagaatactctctacttgcagatgaacagcttaagggctgaggacacggccgtgtattactgtgcaaggattgactacgcagatgcttttgatatctggggccaagggaccacggtcaccgtctcaagcg

SEQ ID NO: 348 - protein, 118 aa, Homo sapien
EVQLLESGGGLVQPGGSLRLSCAASGFTFSHYEMAWVRQAPGKGLEWVSYISSSGGWTSYADSVKGRFTISRDNSKNTLYLQMNSLRAEDTAVYYCARIDYADAFDIWGQGTTVTVSS

SEQ ID NO: 349 - DNA, 322 bp, Homo sapien
gatattgtgatgacccagactccactctccctgtctgcatctgtaggagacagagtcaccatcacttgccgggcaagtcagagcatcgacacctatttaaattggtatcagcagaaaccagggaaagcccctaaactcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccgctcactttcggcggagggaccaaagtggatatcaaac

SEQ ID NO: 350 - protein, 107 aa, Homo sapien
DIVMTQTPLSLSASVGDRVTITCRASQSIDTYLNWYQQKPGKAPKLLIYAASSLQSGVPSRFSGSGSGTDFTLTISSLQPEDFATYYCQQSYSTPLTFGGGTKVDIK

SEQ ID NO: 351 - DNA, 355 bp, Homo sapien
gaagttcaattgttagagtctggtggcggtcttgttcagcctggtggttctttacgtctttcttgcgctgcttccggattcactttctcttggtacgatatggtttgggttcgccaagctcctggtaaaggtttggagtgggtttctgttatctctccttctggtggctgaacttcttatgctgactccgttaaaggtcgcttcactatctctagagacaactctaagaatactctctacttgcagatgaacagcttaagggctgaggacacggccgtgtattactgtgcgagagcgagcagtggtgatgcttttgatatctggggccaagggaccacggtcaccgtctcaagcg

SEQ ID NO: 352 - protein, 118 aa, Homo sapien
EVQLLESGGGLVQPGGSLRLSCAASGFTFSWYDMVWVRQAPGKGLEWVSVISPSGGWTSYADSVKGRFTISRDNSKNTLYLQMNSLRAEDTAVYYCARASSGDAFDIWGQGTTVTVSS

SEQ ID NO: 353 - DNA, 349 bp, Homo sapien
cagtctgtgctgacgcagccgccctcagcgtctgggacccccggacagagggtcagtatctcgtgttctggaagcagttccaacatcggagctaattatgtttcctggtaccagcagctcccaggaacggcccccagactcctcatctatactaatgatcagcggccctcaggggtccctgaccgattctctggctccaagtctggcacctcagcctccctggccatcagtggcctccggtccgaagatgaggctgattattactgtgcagcgtgggatgacagcccgactggtgatgacagcctgagttcgtatgtcttcggaactgggaccaaggtcaccgtcctag

SEQ ID NO: 354 - protein, 116 aa, Homo sapien
QSVLTQPPSASGTPGQRVSISCSGSSSNIGANYVSWYQQLPGTAPRLLIYTNDQRPSGVPDRFSGSKSGTSASLAISGLRSEDEADYYCAAWDDSPTGDDSLSSYVFGTGTKVTVL

SEQ ID NO: 355 - DNA, 355 bp, Homo sapien
gaagttcaattgttagagtctggtggcggtcttgttcagcctggtggttctttacgtctttcttgcgctgcttccggattcactttctctcattacgagatggcttgggttcgccaagctcctggtaaaggtttggagtgggtttcttatatctctccttctggtggctgaacttcttatgctgactccgttaaaggtcgcttcactatctctagagacaactctaagaatactctctacttgcagatgaacagcttaagggctgaggacacggccgtgtattactgtgcgagagaggggcccttagacgcttttgatatctggggccaagggaccacggtcaccgtctcaagcg

SEQ ID NO: 356 - protein, 118 aa, Homo sapien
EVQLLESGGGLVQPGGSLRLSCAASGFTFSHYEMAWVRQAPGKGLEWVSYISPSGGWTSYADSVKGRFTISRDNSKNTLYLQMNSLRAEDTAVYYCAREGPLDAFDIWGQGTTVTVSS

SEQ ID NO: 357 - DNA, 322 bp, Homo sapien
gaaattgtgttgacacagtctccatcctccctgtctgcatctgtaggagacagagtcaccatcacttgccgggcaagtcagagcattagcagctatttaaattggtattagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccccctcactttcggcggagggaccaaggtggaaatcaagc

SEQ ID NO: 358 - protein, 364 aa, Homo sapien
GAAGTTCAATTGTTAGAGTCTGGTGGCGGTCTTGTTCAGCCTGGTGGTTCTTTACGTCTTTCTTGCGCTGCTTCCGGATTCACTTTCTCTAAGTACGATATGCATTGGGTTCGCCAAGCTCCTGGTAAAGGTTTGGAGTGGGTTTCTGTTATCTCTCCTTCTGGTGGCTGGACTTCTTATGCTGACTCCGTTAAAGGTCGCTTCACTATCTCTAGAGACAACTCTAAGAATACTCTCTACTTGCAGATGAACAGCTTAAGGGCTGAGGACACCGCCATGTATTACTGTGCGAGGGATGACTACAGTAAAGGACGGGATGCTTTTGATATCTGGGGCCAAGGGACCACGGTCACCGTCTCAAGCG

SEQ ID NO: 359 - DNA, 364 bp, Homo sapien; identical to SEQ ID NO: 167

SEQ ID NO: 360 - protein, 121 aa, Homo sapien; identical to SEQ ID NO: 168

SEQ ID NO: 361 - DNA, 322 bp, Homo sapien
gaaattgtgttgacgcagtctccatcctccctgtctgcatctgtaggagacagagtcaccatcacttgccgggcaagtcagagcattagcagctatttaaattggtattagcagaaaccagggaaagcccctaagctcctgatctatgctgcatccagtttgcaaagtggggtcccatcaaggttcagcggcagtggatctggcacagatttcactctcgccatcagcagtctgcaacctgaagattttgcaacttactactgtcaacagagttacagtacccccctcactttcggcggagggaccaaggtggaaatcaaac

SEQ ID NO: 362 - protein, 107 aa, Homo sapien
EIVLTQSPSSLSASVGDRVTITCRASQSISSYLNWYQQKPGKAPKLLIYAASSLQSGVPSRFSGSGSGTDFTLAISSLQPEDFATYYCQQSYSTPLTFGGGTKVEIK

SEQ ID NO: 363 - DNA, 364 bp, Homo sapien
gaagttcaattgttagagtctggtggcggtcttgttcagcctggtggttctttacgtctttcttgcgctgcttccggattcactttctctaagtacgatatgcattgggttcgccaagctcctggtaaaggtttggagtgggtttctgttatctctccttctggtggctgggcttcttatgctgactccgttaaaggtcgcttcactatctctagagacaactctaagaatactctctacttgcagatgaacagcttaagggctgaggacaccgccatgtattactgtgcgagggatgactacagtaaaggacgggatgcttttgatatctggggccaagggaccacggtcaccgtctcaagcg

SEQ ID NO: 364 - protein, 121 aa, Homo sapien
EVQLLESGGGLVQPGGSLRLSCAASGFTFSKYDMHWVRQAPGKGLEWVSVISPSGGWASYADSVKGRFTISRDNSKNTLYLQMNSLRAEDTAMYYCARDDYSKGRDAFDIWGQGTTVTVSS

SEQ ID NO: 365 - DNA, 322 bp, Homo sapien
gaaattgtgttgacgcagtctccatcctccctgtctgcatctgtgggagacagagtcgccatcacttgccgggcaagtcagagcattagcagctatttaaattggtattagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccgtacacttttggccaggggaccaaagtggatatcaaac

SEQ ID NO: 366 - protein, 107 aa, Homo sapien
EIVLTQSPSSLSASVGDRVAITCRASQSISSYLNWYQQKPGKAPKLLIYAASSLQSGVPSRFSGSGSGTDFTLTISSLQPEDFATYYCQQSYSTPYTFGQGTKVDIK

SEQ ID NO: 367 - DNA, 364 bp, Homo sapien; identical to SEQ ID NO: 175

SEQ ID NO: 368 - protein, 121 aa, Homo sapien; identical to SEQ ID NO: 176

SEQ ID NO: 369 - DNA, 322 bp, Homo sapien
gaaattgtgctgactcagtctccactctccctgtctgcatctgtaggagacagagtcaccatcacttgtcgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcttactttcggcggagggaccaaagtggatatcaaac

SEQ ID NO: 370 - protein, 107 aa, Homo sapien
EIVLTQSPLSLSASVGDRVTITCRASQSISSYLNWYQQKPGKAPKLLIYAASSLQSGVPSRFSGSGSGTDFTLTISSLQPEDFATYYCQQSYSTPLTFGGGTKVDIK

SEQ ID NO: 371 - DNA, 364 bp, Homo sapien
gaagttcaattgttagagtctggtggcggtcttgttcagcctggtggttctttacgtctttcttgcgctgcttccggattcactttctctaagtacgatatgcattgggttcgccaagctcctggtaaaggtttggagtgggtttctgttatctctccttctggtggctgaacttcttatgctgactccgttaaaggtcgcttcactatctccagagacaactctaagaatactctctacttgcagatgaacagcttaagggctgaggacaccgccatgtattactgtgcgagggatgactacagtaaaggacgggatgcttttgatatctggggccaagggaccctggtcaccgtctcaagcg

SEQ ID NO: 372 - protein, 121 aa, Homo sapien; identical to SEQ ID NO: 176

SEQ ID NO: 373 - DNA, 322 bp, Homo sapien
aacatccagatgacccagtctccatcctccctgtctgcatctgtaggagacagagtcaccatcacttgccgggcaagtcaaagcattagcagctatttaaattggtatcagcagaaaccagggaaagcccctgagctcctgatctatgctgcctccagtttgcaaagtggggtcccatcaaggttcagtggcagtggatctgggacagatttcactctcaccatcagcagtctgcaacctgaagattttgcaacttactactgtcaacagagttacagtacccctctcactttcggcggagggaccaaggtggagatcaaac

SEQ ID NO: 374 - protein, 107 aa, Homo sapien
NIQMTQSPSSLSASVGDRVTITCRASQSISSYLNWYQQKPGKAPELLIYAASSLQSGVPSRFSGSGSGTDFTLTISSLQPEDFATYYCQQSYSTPLTFGGGTKVEIK

SEQ ID NO: 375 - DNA, 358 bp, Homo sapien
gaagttcaattgttagagtctggtggcggtcttgttcagcctggtggttctttacgtctttcttgcgctgcttccggattcactttctcttggtacgatatggtttgggttcgccaagctcctggtaaaggtttggagtgggtttctgttatctctccttctggtggctgaacttcttatgctgactccgttaaaggtcgcttcactatctctagagacaactctaagaatactctctacttgcagatgaacagcttaagggctgaggacacagccacatattactgtgcgagagcggatagtgactacgattcatttgactactggggccaggggaccctggtcaccgtctcaagcg

SEQ ID NO: 376 - protein, 119 aa, Homo sapien
EVQLLESGGGLVQPGGSLRLSCAASGFTFSWYDMVWVRQAPGKGLEWVSVISPSGGWTSYADSVKGRFTISRDNSKNTLYLQMNSLRAEDTATYYCARADSDYDSFDYWGQGTLVTVSS

SEQ ID NO: 377 - DNA, 322 bp, Homo sapien
gaaattgtaatgacgcagtctccatcctccctgtctgcatctgtaggagacagagtcaccatcacttgccgggcaagtcagagcattagcagctatttaaattggtattagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccccctcactttcggcggagggaccaaggtggaaatcaaac

SEQ ID NO: 378 - protein, 355 aa, Homo sapien
GAAGTTCAATTGTTAGAGTCTGGTGGCGGTCTTGTTCAGCCTGGTGGTTCTTTACGTCTTTCCTGCGCTGCTTCCGGATTCACTTTCTCTCATTACGAGATGGGTTGGGTTCGCCAAGCTCCTGGTAAAGGTTTGGAGTGGGTTTCTTATATCTCTTCTTCTGGTGGCTGGACTACTTATGCTGACTCCGTTAAAGGTCGCTTCACTATCTCTAGAGACAACTCTAAGAATACTCTCTACTTGCAGATGAACAGCTTAAGGGCTGAGGACACGGCCGTGTATTACTGTGCAAGGATTGACTACGCAGATGCTTTTGATATCTGGGGCCAAGGCACCCTGGTCACTGTCTCAAGCG

SEQ ID NO: 379 - DNA, 355 bp, Homo sapien
gaagttcaattgttagagtctggtggcggtcttgttcagcctggtggttctttacgtctttcctgcgctgcttccggattcactttctctcattacgagatgggttgggttcgccaagctcctggtaaaggtttggagtgggtttcttatatctcttcttctggtggctggactacttatgctgactccgttaaaggtcgcttcactatctctagagacaactctaagaatactctctacttgcagatgaacagcttaagggctgaggacacggccgtgtattactgtgcaaggattgactacgcagatgcttttgatatctggggccaaggcaccctggtcactgtctcaagcg

SEQ ID NO: 380 - protein, 118 aa, Homo sapien
EVQLLESGGGLVQPGGSLRLSCAASGFTFSHYEMGWVRQAPGKGLEWVSYISSSGGWTTYADSVKGRFTISRDNSKNTLYLQMNSLRAEDTAVYYCARIDYADAFDIWGQGTLVTVSS

SEQ ID NO: 381 - DNA, 322 bp, Homo sapien
gaaattgtgttgacgcagtctccatcctccctgtctgcatctgtgggagacagagtcgccatcgcttgccgcgcaagtcagagcatcgacacctatttaaattggtatcagcaaaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacacccctcactttcggcggagggaccaaggtggaaatcaagc

SEQ ID NO: 382 - protein, 107 aa, Homo sapien
EIVLTQSPSSLSASVGDRVAIACRASQSIDTYLNWYQQKPGKAPKLLIYAASSLQSGVPSRFSGSGSGTDFTLTISSLQPEDFATYYCQQSYSTPLTFGGGTKVEIK

SEQ ID NO: 383 - DNA, 355 bp, Homo sapien
gaagttcaattgttagagtctggtggcggtcttgttcagcctggtggttctttacgtctttcttgcgctgcttccggattcactttctcttggtacgatatggtttgggttcgccaagctcctggtaaaggtttggagtgggtttctgttatctctccttctggtggctgaacttcttatgctgactccgttaaaggtcgcttcactatctctagagacaactctaagaatactctctacttgcagatgaacagcttaagggctgaggacacggccgtgtattactgtgcgagagcgagcagtggtgatgcttttgatatctggggccaaggcaccctggtcaccgtctcaagcg

SEQ ID NO: 384 - protein, 118 aa, Homo sapien
EVQLLESGGGLVQPGGSLRLSCAASGFTFSWYDMVWVRQAPGKGLEWVSVISPSGGWTSYADSVKGRFTISRDNSKNTLYLQMNSLRAEDTAVYYCARASSGDAFDIWGQGTLVTVSS

SEQ ID NO: 385 - DNA, 322 bp, Homo sapien
gaaattgtgttgacgcagtctccatcctccctgtctgcatctgtaggagacagagtcaccatcacttgccgggcaagtcagagcattagcagctatttaaattggtatcagcagaaaccagggaaagcccctaagctcctgatctatggtgcatccagtttgcaaagtggggtcccatcaaggttcagcggcagtggatctggcacagatttcactctcaccatcagcagtctgcaacctgaagattttgcaacttactactgtcaacagagttacagtaccccgctcactttcggcggagggaccaaggtggaaatcaagc

SEQ ID NO: 386 - protein, 107 aa, Homo sapien
EIVLTQSPSSLSASVGDRVTITCRASQSISSYLNWYQQKPGKAPKLLIYGASSLQSGVPSRFSGSGSGTDFTLTISSLQPEDFATYYCQQSYSTPLTFGGGTKVEIK

SEQ ID NO: 387 - DNA, 355 bp, Homo sapien
gaagttcaattgttagagtctggtggcggtcttgttcagcctggtggttctttacgtctttcttgcgctgcttccggattcactttctcttggtacgatatggtttgggttcgccaagctcctggtaaaggtttggagtgggtttctgttatctctccttctggtggctgaacttcttatgctgactccgttaaaggtcgcttcactatctctagagacaactctaagaatactctctacttgcagatgaacagcttaagggctgaggacactgccgtgtattactgtgcgagagcgagcagtggtgatgcttttgatatctggggccaaggcaccctggtcaccgtctcaagcg

SEQ ID NO: 388 - protein, 118 aa, Homo sapien; identical to SEQ ID NO: 384

SEQ ID NO: 389 - DNA, 322 bp, Homo sapien
gaaattgtaatgacgcagtctccatcctccctgtctgcatctgtgggagacagagtcgccatcacttgccgcgcaagtcagagcatcgacacctatttaaattggtatcagcagaaaccagggaaagcccctaagctcctgatctatgctgcatccagtttgcaaagtggggtcccatcaaggttcagtggcagtggatctggcacagatttcactctcactatcagcagtctgcaacctgaagattttgcaatttactactgtcaacagagttacagtacccctctcactttcggcggagggaccaaggtggaaatcaagc

SEQ ID NO: 390 - protein, 107 aa, Homo sapien
EIVMTQSPSSLSASVGDRVAITCRASQSIDTYLNWYQQKPGKAPKLLIYAASSLQSGVPSRFSGSGSGTDFTLTISSLQPEDFAIYYCQQSYSTPLTFGGGTKVEIK

SEQ ID NO: 391 - DNA, 355 bp, Homo sapien
gaagttcaattgttagagtctggtggcggtcttgttcagcctggtggttctttacgtctttcttgcgctgcttccggattcactttctcttggtacgatatggtttgggttcgccaagctcctggtaaaggtttggagtgggtttctgttatctctccttctggtggctgaacttcttatgctgactccgttaaaggtcgcttcactatctctagagacaactctaagaatactctctacttgcagatgaacagcttaagggctgaggacacggccgtgtattactgtgcgagagcgagcagtggtgatgcttttgatatctggggccaagggacaatggtcaccgtctcaagcg

SEQ ID NO: 392 - protein, 118 aa, Homo sapien
EVQLLESGGGLVQPGGSLRLSCAASGFTFSWYDMVWVRQAPGKGLEWVSVISPSGGWTSYADSVKGRFTISRDNSKNTLYLQMNSLRAEDTAVYYCARASSGDAFDIWGQGTMVTVSS

SEQ ID NO: 393 - DNA, 322 bp, Homo sapien
gatgttgtgatgacacagtctccactctccctgtccgcatctgtgggagacagagtcgccatcacttgccgcgcaagtcagagcatcgacacctatttaaattggtattagcagaaaccagggaaagcccctaagcccctgatctatgctgcatccagtttgcgaagtggggtcccatcaaggttcagtggcagtggatctgggacagatttcactctcaccatcagcagtctgcaacctgaagattttgcaacttactactgtcaacagagttacagtacctcccttactttcggcggagggaccaaagtggatatcaaac

SEQ ID NO: 394 - protein, 107 aa, Homo sapien
DVVMTQSPLSLSASVGDRVAITCRASQSIDTYLNWYQQKPGKAPKPLIYAASSLRSGVPSRFSGSGSGTDFTLTISSLQPEDFATYYCQQSYSTSLTFGGGTKVDIK

SEQ ID NO: 395 - DNA, 340 bp, Homo sapien
gaagttcaattgttagagtctggtggcggtcttgttcagcctggtggttctttacgtctttcttgcgctgcttccggattcactttctctggttacattatgtggtgggttcgccaagctcctggtaaaggtttggagtgggtttctgttatctctccttctggtggcgatacttggtatgctgactccgttaaaggtcgcttcactatctctagagacaactctaagaatactctctacttgcagatgaacagcttaagggctgaggacacggccgtgtattactgtgccacggcgggagactactggggccagggcaccctggtcactgtctcaagcg

SEQ ID NO: 396 - protein, 113 aa, Homo sapien; identical to SEQ ID NO: 172

SEQ ID NO: 397 - DNA, 322 bp, Homo sapien
gaaattgtaatgacgcagtctccatcctccctgtctgcatctgtaggagacagagtcaccataacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggccctgggaccaaggtggaaatcaaac

SEQ ID NO: 398 - protein, 107 aa, Homo sapien
EIVMTQSPSSLSASVGDRVTITCRASQSISSYLNWYQQKPGKAPKLLIYAASSLQSGVPSRFSGSGSGTDFTLTISSLQPEDFATYYCQQSYSTPLTFGPGTKVEIK

SEQ ID NO: 399 - DNA, 355 bp, Homo sapien; identical to SEQ ID NO: 391

SEQ ID NO: 400 - protein, 118 aa, Homo sapien; identical to SEQ ID NO: 392

SEQ ID NO: 401 - DNA, 322 bp, Homo sapien
gaaattgtgttgacgcagtctccactctccctgtctgcatctgtaggagacagagtcaccatcacttgccgggcaagtcagagcattagcacctatttaaattggtatcagcagaaaccagggaaagcccctagactcctgatctatgctgcatccagtttgcaaagtggggtcccgtcaaggttcagtggcagtggatctgggacagatttcactctcaccatcagcagtctgcaacctgaagattttgcaacttactactgtcaacagagttacagtaccccgatcaccttcggccaagggacacgactggagattaaac

SEQ ID NO: 402 - protein, 107 aa, Homo sapien
EIVLTQSPLSLSASVGDRVTITCRASQSISTYLNWYQQKPGKAPRLLIYAASSLQSGVPSRFSGSGSGTDFTLTISSLQPEDFATYYCQQSYSTPITFGQGTRLEIK

SEQ ID NO: 403 - DNA, 355 bp, Homo sapien
gaagttcaattgttagagtctggtggcggtcttgttcagcctggtggttctttacgtctttcttgcgctgcttccggattcactttctcttggtacgatatgggttgggttcgccaagctcctggtaaaggtttggagtgggtttctgttatctctccttctggtggctgaacttcttatgctgactccgttaaaggtcgcttcactatctctagagacaactctaagaatactctctacttgcagatgaacagcttaagggctgaggacacggccgtgtattactgtgcgagagcgagcagtggtgatgcttttgatatctggggccaaggcaccctggtcactgtctcaagcg

SEQ ID NO: 404 - protein, 118 aa, Homo sapien
EVQLLESGGGLVQPGGSLRLSCAASGFTFSWYDMGWVRQAPGKGLEWVSVISPSGGWTSYADSVKGRFTISRDNSKNTLYLQMNSLRAEDTAVYYCARASSGDAFDIWGQGTLVTVSS

SEQ ID NO: 405 - DNA, 322 bp, Homo sapien
gacatccagttgacccagtctccatcctccctgtctgcatctgtaggagacagagtcaccatcacttgccgggcaagtcagagcattagcagctatttaaattggtattagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccccctcactttcggcggagggacacgactggagattaaac

SEQ ID NO: 406 - protein, 107 aa, Homo sapien
DIQLTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTRLEIK

SEQ ID NO: 407 - DNA, 364 bp, Homo sapien
gaagttcaattgttagagtctggtggcggtcttgttcagcctggtggttctttacgtctttcttgcgctgcttccggattcactttctctaagtacgatatgcattgggttcgccaagctcctggtaaaggtttggagtgggtttctgttatctctccttctggtggctggacttcttatgctgaccccgttaaaggtcgcttcactatctctagagacaactctaagaatactctctacttgcagatgaacagcttaagggctgaggacaccgccatgtattactgtgcgagggatgactacagtaaaggacgggatgcttttgatatctggggccaagggacaatggtcaccgtctcaagcg

SEQ ID NO: 408 - protein, 121 aa, Homo sapien
EVQLLESGGGLVQPGGSLRLSCAASGFTFSKYDMHWVRQAPGKGLEWVSVISPSGGWTSYADPVKGRFTISRDNSKNTLYLQMNSLRAEDTAMYYCARDDYSKGRDAFDIWGQGTMVTVSS

SEQ ID NO: 409 - DNA, 322 bp, Homo sapien
gccatctggatgacccagtctccatcctccctgtctgcatctgtaggagacagagtcaccatcacttgccgggcaagtcagagcattagcagctatttaaattggtatcagcagaaaccagggaaagcccctaagctcctgatctacgctgcatccagtttgcaaagtggggtcccatcaaggttcagtggcagtgggtctgggacagatttcactctcaccatcagcagtctgcaacctgaagattctgcaacttactactgtcaacagagttacagtaccccgtacactttcggcggagggaccaaggtggagatcaaac

SEQ ID NO: 410 - protein, 107 aa, Homo sapien
AIWMTQSPSSLSASVGDRVTITCRASQSISSYLNWYQQKPGKAPKLLIYAASSLQSGVPSRFSGSGSGTDFTLTISSLQPEDSATYYCQQSYSTPYTFGGGTKVEIK

SEQ ID NO: 411 - DNA, 349 bp, Homo sapien
gaagttcaattgttagagtctggtggcggtcttgttcagcctggtggttctttacgtctttcttgcgctgcttccggattcactttctcttggtacgatatggtttgggttcgccaagctcctggtaaaggtttggagtgggtttctgttatctctccttctggtggctgaacttcttatgctgactccgttaaaggtcgcttcactatctctagagacaactctaagaatactctctacttgcagatgaacagcttaagggctgaggacacggccgtgtattactgtgcgagagcgagcagtggtgatgcttttgatatctggggccaagggaccacggtcaccgtct

SEQ ID NO: 412 - protein, 116 aa, Homo sapien
EVQLLESGGGLVQPGGSLRLSCAASGFTFSWYDMVWVRQAPGKGLEWVSVISPSGGWTSYADSVKGRFTISRDNSKNTLYLQMNSLRAEDTAVYYCARASSGDAFDIWGQGTTVTV

SEQ ID NO: 413 - DNA, 322 bp, Homo sapien
gatgttgtgatgacacagtctccatcctccctgtctgcatctgtaggagacagagtcaccatcacttgccgggcaagtcagagcattagcagctatttaaattggtattagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccccctcactttcggcggagggaccaaggtggaaatcaagc

SEQ ID NO: 414 - protein, 107 aa, Homo sapien; identical to SEQ ID NO: 334

SEQ ID NO: 415 - DNA, 364 bp, Homo sapien
gaagttcaattgttagagtctggtggcggtcttgttcagcctggtggttctttacgtctttcttgcgctgcttccggattcactttctctcgttacgatatggagtgggttcgccaagctcctggtaaaggtttggagtgggtttcttctatctctccttctggtggctggacttcttatgctgactccgttaaaggtcgcttcactatctctagagacaactctaagaatactctctacttgcagatgaacagcttaagggctgaggacacggccgtgtattactgtgcgagagatcatagtggctacgattctgaatactttgactactggggccaggggaccctggtcaccgtctcaagcg

SEQ ID NO: 416 - protein, 121 aa, Homo sapien; identical to SEQ ID NO: 228

SEQ ID NO: 417 - DNA, 322 bp, Homo sapien
gccatctggatgacccagtctccatcctccctgtctgcatctgtaggagacagagtcaccatcacttgccgggcaagtcagagcattagcagctatttaaattggtattagcagaaaccagggaaagcccctaagctcctgatctatgctgcatccagtttgcaaagtggggtcccatcaaggttcagtggcggcggatctgggacagatttcactctcaccatcagcagtctgcagcctgaagattttgcaacttactactgtcaacagagttacagtacccccctcactttcggcggagggacacgactggagattaaac

SEQ ID NO: 418 - protein, 107 aa, Homo sapien
AIWMTQSPSSLSASVGDRVTITCRASQSISSYLNWYQQKPGKAPKLLIYAASSLQSGVPSRFSGGGSGTDFTLTISSLQPEDFATYYCQQSYSTPLTFGGGTRLEIK

SEQ ID NO: 419 - DNA, 340 bp, Homo sapien
gacgttcaattgttagagtctggtggcggtcttgttcagcctggtggttctttacgtctttcttgcgctgcttccggattcacttcctctggttacattatgtggtgggttcgccaagctcctggtaaaggtttggagtgggtttctgttatctctccttctggtggcgatacttggtatgctgactccgttaaaggtcgcttcactatctctagagacaactctaagaatactctctacttgcagatgaacagcttaagggctgaggacacggccgtgtattactgtgccacagcgggagactactggggccagggcaccctggtcactgtctcaagcg

SEQ ID NO: 420 - protein, 113 aa, Homo sapien
DVQLLESGGGLVQPGGSLRLSCAASGFTSSGYIMWWVRQAPGKGLEWVSVISPSGGDTWYADSVKGRFTISRDNSKNTLYLQMNSLRAEDTAVYYCATAGDYWGQGTLVTVSS

SEQ ID NO: 421 - DNA, 322 bp, Homo sapien
gaaattgtaatgacgcagtctccatcctccctgtctgcatctgtaggagacagagtcaccatcacttgccgggcaagtcagagcattagcagctatttaaattggtattagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccgctcactttcggcggagggaccaaggtggaaatcaaac

SEQ ID NO: 422 - protein, 107 aa, Homo sapien; identical to SEQ ID NO: 194

SEQ ID NO: 423 - DNA, 364 bp, Homo sapien
gaagttcaattgttagagtctggtggcggtcttgttcagcctggtggttctttacgtctttcttgcgctgcttccggattcactttctcttggtacgatatggtttgggttcgccaagctcctggtaaaggtttggagtgggtttctgttatctctccttctggtggctggacttcttatgctgactccgttaaaggtcgcttcactatctctagagacaactctaagaatactctctacttgcagatgaacagcttaagggctgaggacaccgccatgtattactgtgcgagggatgactacagtaaaggacgggatgcttttgatatctggggccaagggaccctggtcaccgtctcaagcg

SEQ ID NO: 424 - protein, 121 aa, Homo sapien
EVQLLESGGGLVQPGGSLRLSCAASGFTFSWYDMVWVRQAPGKGLEWVSVISPSGGWTSYADSVKGRFTISRDNSKNTLYLQMNSLRAEDTAMYYCARDDYSKGRDAFDIWGQGTLVTVSS

SEQ ID NO: 425 - DNA, 322 bp, Homo sapien
gaaattgtgctgactcagtctccatcttccgtgtctgcatctgtaggagacagagtcaccatcacttgtcgggcgagtcagagtattagcacctatttaaattggtatcggcagaaaccagggaaagcccctaacctcctgatctctactgcatccaatttgcaaagtggggtcccgtcaaggttcagtggcagtggatctgggacagatttcactctcaccatcagcagtctgcaacctgaagattttgcaacttactcctgtcaacaaagttacagtacccctttcactttcggccctgggaccaaagtggatatcaaac

SEQ ID NO: 426 - protein, 107 aa, Homo sapien
EIVLTQSPSSVSASVGDRVTITCRASQSISTYLNWYRQKPGKAPNLLISTASNLQSGVPSRFSGSGSGTDFTLTISSLQPEDFATYSCQQSYSTPFTFGPGTKVDIK

SEQ ID NO: 427 - DNA, 355 bp, Homo sapien
gaagttcaattgttagagtctggtggcggtcttgttcagcctggtggttctttacgtctttcttgcgctgcttccggattcactttctcttggtacgatatggtttgggttcgccaagctcctggtaaaggtttggagtgggtttctgttatctctccttctggtggctgaacttcttatgctgactccgttaaaggtcgcttcactatctctagagacaactctaggaatactctctacttgcagatgaacagcttaagggctgaggacacggccatgtattactgtgcgagagcgagcagtggtgatgcttttgatatctggggccaagggaccctggtcaccgtctcaagcg

SEQ ID NO: 428 - protein, 118 aa, Homo sapien
EVQLLESGGGLVQPGGSLRLSCAASGFTFSWYDMVWVRQAPGKGLEWVSVISPSGGWTSYADSVKGRFTISRDNSRNTLYLQMNSLRAEDTAMYYCARASSGDAFDIWGQGTLVTVSS

SEQ ID NO: 429 - DNA, 322 bp, Homo sapien
gatgttgtgatgacacagtctccatcctccctgtctgcatctgtaggagacagagtcaccatcacttgccgggcaagtcagagcattagcagctatttaaattggtattagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccgtacacttttggccaagggacacgactggagattaaac

SEQ ID NO: 430 - protein, 107 aa, Homo sapien
DVVMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTRLEIK

SEQ ID NO: 431 - DNA, 340 bp, Homo sapien
gaagttcaattgttagagtctggtggcggtcttgttcagcctggtggttctttacgtctttcttgcgctgcttccggattcacttcctctggttacattatgtggtgggttcgccaagctcctggtaaaggtttggagtgggtttctgttatctctccttctggtggcgatacttggtatgctgactccgttaaaggtcgcttcactatctctagagacaactctaagaatactctctacttgcagatgaacagcttaagggctgaggacacggccgtgtattactgtgccacagcgggagactactggggccagggcaccctggtcactgtctcaagcg

SEQ ID NO: 432 - protein, 113 aa, Homo sapien
EVQLLESGGGLVQPGGSLRLSCAASGFTSSGYIMWWVRQAPGKGLEWVSVISPSGGDTWYADSVKGRFTISRDNSKNTLYLQMNSLRAEDTAVYYCATAGDYWGQGTLVTVSS

SEQ ID NO: 433 - protein, 17 aa, Artificial
  Anti-PDGFRbeta Consensus LCDR1
  MISC_FEATURE (6)..(6): Xaa is Val or Leu
  MISC_FEATURE (10)..(10): Xaa is Ser, Ala, or Pro
  MISC_FEATURE (12)..(12): Xaa is Asn or Lys
KSSQSXLYSXNXKNYLA

SEQ ID NO: 434 - protein, 7 aa, Artificial
  Anti-PDGFRbeta Consensus LCDR2
  MISC_FEATURE (1)..(1): Xaa is Trp or Arg
XASTRES

SEQ ID NO: 435 - protein, 9 aa, Artificial
  Anti-PDGFRbeta Consensus LCDR3
  MISC_FEATURE (6)..(6): Xaa is Thr or Ile
  MISC_FEATURE (8)..(8): Xaa is Tyr, Phe, Trp, or Ile
QQYYSXPXT

SEQ ID NO: 436 - protein, 5 aa, Artificial
  Anti-PDGFRbeta Consensus HCDR1
  MISC_FEATURE (1)..(1): Xaa is Lys, Gln, Arg, Met, Gly, or Asn
  MISC_FEATURE (3)..(3): Xaa is Lys, Met, Val, Phe, Ile, Ser, Arg, or Pro
  MISC_FEATURE (5)..(5): Xaa is Leu, Gln, Thr, Ser, Glu, Val, or Gly
XYXMX

SEQ ID NO: 437 - protein, 17 aa, Artificial
  Anti-PDGFRbeta Consensus HCDR2
  MISC_FEATURE (1)..(1): Xaa is Ser or Gly
  MISC_FEATURE (3)..(3): Xaa is Tyr, Ser, or Trp
  MISC_FEATURE (8)..(8): Xaa is Val, Ile, Leu, or Met
  MISC_FEATURE (10)..(10): Xaa is Phe, Thr, or Val
XIXPSGGXTXYADSVKG

SEQ ID NO: 438 - protein, 13 aa, Homo sapien
DGIPLSIAAPIDY

SEQ ID NO: 439 - protein, 12 aa, Homo sapien
DRPTGKTGYFQH

SEQ ID NO: 440 - protein, 12 aa, Homo sapien
AYSSGWSLPFDY

SEQ ID NO: 441 - protein, 13 aa, Homo sapien
ARRMRSLWEAFDI

SEQ ID NO: 442 - protein, 12 aa, Homo sapien
DGEMISGSFFDS

SEQ ID NO: 443 - protein, 17 aa, Homo sapien
KSSQSVLYSSNNKNYLA

SEQ ID NO: 444 - protein, 9 aa, Artificial Sequence
  anti-PDGFRbeta Consensus LCDR3
  MISC_FEATURE (8)..(8): Xaa is Tyr, Trp, or Ile
QQYYSTPXT

SEQ ID NO: 445 - protein, 5 aa, Artificial Sequence
  anti-PDGFRbeta Consensus HCDR1
  MISC_FEATURE (1)..(1): Xaa is Lys, Glu, Arg, or Met
  MISC_FEATURE (3)..(3): Xaa is Lys, Met, Val, or Phe
  MISC_FEATURE (5)..(5): Xaa is Leu, Gln, Thr, or Ser
XYXMX

SEQ ID NO: 446 - protein, 5 aa, Artificial Sequence
  anti-PDGFRbeta Consensus HCDR1
  MISC_FEATURE (5)..(5): Xaa is Leu or Gln
KYKMX

SEQ ID NO: 447 - protein, 17 aa, Artificial Sequence
  anti-PDGFRbeta Consensus HCDR2
  MISC_FEATURE (3)..(3): Xaa is Tyr or Ser
  MISC_FEATURE (8)..(8): Xaa is Val or Leu
SIXPSGGXTFYADSVKG

SEQ ID NO: 448 - protein, 11 aa, Artificial Sequence
  Anti-VEGF-A Consensus LCDR1
  MISC_FEATURE (2)..(2): Xaa is Ala, Thr, or Ser
  MISC_FEATURE (4)..(4): Xaa is Gln or Glu
  MISC_FEATURE (5)..(5): Xaa is Ser, Gly, Thr, or Asn
  MISC_FEATURE (7)..(7): Xaa is Ser, Asp, Arg, or Asn
  MISC_FEATURE (8)..(8): Xaa is Ser, Thr, Arg, Gly, or Asn
  MISC_FEATURE (9)..(9): Xaa is Tyr or Phe
  MISC_FEATURE (10)..(10): Xaa is Leu or Val
RXSXXIXXXXN

SEQ ID NO: 449 - protein, 7 aa, Artificial Sequence
  Anti-VEGF-A Consensus LCDR2
  MISC_FEATURE (1)..(1): Xaa is Ala, Gly, Asp, or Thr
  MISC_FEATURE (2)..(2): Xaa is Ala or Arg
  MISC_FEATURE (4)..(4): Xaa is Ser, Thr, Lys, Asn, or Arg
  MISC_FEATURE (6)..(6): Xaa is Gln, Glu, Lys, or Arg
  MISC_FEATURE (7)..(7): Xaa is Ser, Asp, or Gly
XXSXLXX

SEQ ID NO: 450 - protein, 9 aa, Artificial Sequence
  Anti-VEGF-A Consensus LCDR3
  MISC_FEATURE (5)..(5): Xaa is Thr or Ser
  MISC_FEATURE (6)..(6): Xaa is Thr, Ala, or Ser
  MISC_FEATURE (7)..(7): Xaa is Pro or Ser
  MISC_FEATURE (8)..(8): Xaa is Leu, Tyr, Pro, Ile, Arg, Val, or Phe or is absent
QQSYXXXXT

SEQ ID NO: 451 - protein, 5 aa, Artificial Sequence
  Anti-VEGF-A Consensus HCDR1
  MISC_FEATURE (1)..(1): Xaa is Lys, Gly, Arg, His, or Trp
  MISC_FEATURE (3)..(3): Xaa is Asp, Ile, or Glu
  MISC_FEATURE (5)..(5): Xss is His, Trp, Glu, Gly, Val, Asp, or Ala
XYXMX

SEQ ID NO: 452 - protein, 17 aa, Artificial Sequence
  Anti-VEGF-A Consensus HCDR2
  MISC_FEATURE (1)..(1): Xaa is Val, Ser, or Tyr
  MISC_FEATURE (4)..(4): Xaa is Pro or Ser
  MISC_FEATURE (8)..(8): Xaa is Try or Asp
  MISC_FEATURE (9)..(9): Xaa is Thr or Ala
  MISC_FEATURE (10)..(10): Xaa is Ser, Trp, Ala, or Thr
  MISC_FEATURE (14)..(14): Xaa is Ser or Pro
XISXSGGXXXYADXVKG

SEQ ID NO: 453 - protein, 12 aa, Homo sapien
DHSGYDSEYFDY

SEQ ID NO: 454 - protein, 12 aa, Homo sapien
DDYSKGRDAFDI

SEQ ID NO: 455 - protein, 13 aa, Homo sapien
DSSGYYSPDAFDI

SEQ ID NO: 456 - protein, 4 aa, Homo sapien
AGDY

SEQ ID NO: 457 - protein, 9 aa, Homo sapien
ASSGDAFDI

SEQ ID NO: 458 - protein, 10 aa, Homo sapien
ADSDYDSFDY

SEQ ID NO: 459 - protein, 9 aa, Homo sapien
IGYADAFDI

SEQ ID NO: 460 - protein, 9 aa, Homo sapien
IDYADAFDI

SEQ ID NO: 461 - protein, 12 aa, Homo sapien
DGYSKGRDAFDI

SEQ ID NO: 462 - protein, 13 aa, Artificial Sequence
  Anti-VEGF-A Consensus LCDR1
  MISC_FEATURE (3)..(3): Xaa is Ser or Val
  MISC_FEATURE (9)..(9): Xaa is Lys, Ser, Arg, or Ala
  MISC_FEATURE (11)..(11): Xaa is Ala, Thr, Pro, Asn, Ser, Tyr, or Ile
  MISC_FEATURE (13)..(13): Xaa is His, Asn, Gln, Thr, or Ser
SGXSSNIGXNXVX

SEQ ID NO: 463 - protein, 7 aa, Artificial Sequence
  Anti-VEGF-A Consensus LCDR2
  MISC_FEATURE (1)..(1): Xaa is Tyr, Gly, Ser, Arg, or Thr
  MISC_FEATURE (2)..(2): Xaa is Asn or Asp
  MISC_FEATURE (3)..(3): Xaa is Asn, Arg, or Asp
  MISC_FEATURE (4)..(4): Xaa is Leu, Gln, or Arg
  MISC_FEATURE (5)..(5): Xaa is Leu or Arg
  MISC_FEATURE (7)..(7): Xaa is Pro or Ser
XXXXXPX

SEQ ID NO: 464 - protein, 11 aa, Artificial Sequence
  Anti-VEGF-A Consensus LCDR3
  MISC_FEATURE (1)..(1): Xaa is Ala or Thr
  MISC_FEATURE (2)..(2): Xaa is Ala or Thr
  MISC_FEATURE (6)..(6): Xaa is Asn or Ser
  MISC_FEATURE (8)..(8): Xaa is Asn or Ser
  MISC_FEATURE (9)..(9): Xaa is Gly or Val
  MISC_FEATURE (10)..(10): Xaa is Pro, Trp, or Val
XXWDDXLXXXV

SEQ ID NO: 465 - protein, 5 aa, Artificial Sequence
  Anti-VEGF-A Consensus HCDR1
  MISC_FEATURE (1)..(1): Xaa is Asp, Gly, or His
  MISC_FEATURE (3)..(3): Xaa is Leu ,Ile, or Glu
  MISC_FEATURE (5)..(5): Xaa is Val, Trp, or Ala
XYXMX

SEQ ID NO: 466 - protein, 17 aa, Homo sapien
AAWDDSPTGDDSLSSYV

SEQ ID NO: 467 - protein, 17 aa, Artificial Sequence
  Anti-VEGF-A Consensus HCDR2
  MISC_FEATURE (1)..(1): Xaa is Tyr or Val
  MISC_FEATURE (8)..(8): Xaa is Trp or Asp
  MISC_FEATURE (10)..(10): Xaa is Ala, Trp, or Ser
XISPSGGXTXYADSVKG

SEQ ID NO: 468 - protein, 4 aa, Homo sapien
AGDY

SEQ ID NO: 469 - protein, 12 aa, Homo sapien
VVELRAGDAFDI

SEQ ID NO: 470 - protein, 9 aa, Homo sapien
EGPLDAFDI

SEQ ID NO: 471 - protein, 13 aa, Artificial Sequence
  Anti-VEGF-A Consensus LCDR1
  MISC_FEATURE (9)..(9): Xaa is Ser or Arg
  MISC_FEATURE (11)..(11): Xaa is Thr, Pro, Asn, or Ile
  MISC_FEATURE (13)..(13): Xaa is Asn or Gln
SGSSSNIGXNXVX

SEQ ID NO: 472 - protein, 13 aa, Artificial Sequence
  Anti-VEGF-A Consensus LCDR1
  MISC_FEATURE (3)..(3): Xaa is Ser or Val
  MISC_FEATURE (9)..(9): Xaa is Lys, Ser, or Arg
  MISC_FEATURE (11)..(11): Xaa is Ala, Thr, Pro, Asn, or Ser
  MISC_FEATURE (13)..(13): Xaa is His, Asn, Gln, or Thr
SGXSSNIGXNXVX

SEQ ID NO: 473 - protein, 13 aa, Artificial Sequence
  Anti-VEGF-A Consensus LCDR1
  MISC_FEATURE (9)..(9): Xaa is Ser or Arg
  MISC_FEATURE (11)..(11): Xaa is Thr, Pro, or Asn
  MISC_FEATURE (13)..(13): Xaa is Asn or Gln
SGSSSNIGXNXVX

SEQ ID NO: 474 - protein, 7 aa, Artificial Sequence
  Anti-VEGF-A Consensus LCDR2
  MISC_FEATURE (1)..(1): Xaa is Gly or Ser
  MISC_FEATURE (2)..(2): Xaa is Asn or Asp
  MISC_FEATURE (3)..(3): Xaa is Asn, Arg, or Asp
  MISC_FEATURE (4)..(4): Xaa is is Gln or Arg
  MISC_FEATURE (7)..(7): Xaa is Pro or Ser
XXXXRPX

SEQ ID NO: 475 - protein, 7 aa, Artificial Sequence
  Anti-VEGF-A Consensus LCDR2
  MISC_FEATURE (1)..(1): Xaa is Tyr, Gly, Ser, or Arg
  MISC_FEATURE (2)..(2): Xaa is Asn or Asp
  MISC_FEATURE (3)..(3): Xaa is Asn or Asp
  MISC_FEATURE (4)..(4): Xaa is Leu, Gln, or Arg
  MISC_FEATURE (5)..(5): Xaa is Leu or Arg
  MISC_FEATURE (7)..(7): Xaa is Pro or Ser
XXXXXPX

SEQ ID NO: 476 - protein, 7 aa, Artificial Sequence
  Anti-VEGF-A Consensus LCDR2
  MISC_FEATURE (1)..(1): Xaa is Gly or Ser
  MISC_FEATURE (2)..(2): Xaa is Asn or Asp
  MISC_FEATURE (3)..(3): Xaa is Asn or Asp
  MISC_FEATURE (4)..(4): Xaa is Gln or Arg
  MISC_FEATURE (7)..(7): Xaa is Pro or Ser
XXXXRPX

SEQ ID NO: 477 - protein, 5 aa, Artificial Sequence
  Anti-VEGF-A Consensus HCDR1
  MISC_FEATURE (1)..(1): Xaa is Asp or Gly
  MISC_FEATURE (3)..(3): Xaa is Leu or Ile
  MISC_FEATURE (5)..(5): Xaa is Val or Trp
XYXMX

SEQ ID NO: 478 - protein, 17 aa, Artificial Sequence
  Anti-VEGF-A Consensus HCDR2
  MISC_FEATURE (1)..(1): Xaa is Try or Val
  MISC_FEATURE (8)..(8): Xaa is Trp or Asp
  MISC_FEATURE (10)..(10): Xaa is Ala or Trp
XISPSGGXTXYADSVKG

SEQ ID NO: 479 - protein, 7 aa, Artificial Sequence
  Anti-VEGF-A Consensus LCDR2
  MISC_FEATURE (1)..(1): Xaa is Tyr, Gly, Ser, or Arg
  MISC_FEATURE (2)..(2): Xaa is Asn or Asp
  MISC_FEATURE (3)..(3): Xaa is Asn or Asp
  MISC_FEATURE (4)..(4): Xaa is Leu, Gln, or Arg
  MISC_FEATURE (5)..(5): Xaa is Leu or Arg
XXXXXPP

SEQ ID NO: 480 - protein, 11 aa, Artificial Sequence
  Anti-VEGF-A Consensus LCDR3
  MISC_FEATURE (2)..(2): Xaa is Ala or Thr
  MISC_FEATURE (8)..(8): Xaa is Asn or Ser
  MISC_FEATURE (9)..(9): Xaa is Gly or Val
  MISC_FEATURE (10)..(10): Xaa is Trp or Val
AXWDDSLXXXV

SEQ ID NO: 481 - protein, 339 aa, Homo sapien
RDESNHLTDLYRRDETIQVKGNGYVQSPRFPNSYPRNLLLTWRLHSQENTRIQLVFDNQFGLEEAENDICRYDFVEVEDISETSTIIRGRWCGHKEVPPRIKSRTNQIKITFKSDDYFVAKPGFKIYYSLLEDFQPAAASETNWESVTSSISGVSYNSPSVTDPTLIADALDKKIAEFDTVEDLLKYFNPESWQEDLENMYLDTPRYRGRSYHDRKSKVDLDRLNDDAKRYSCTPRNYSVNIREELKLANVVFFPRCLLVQRCGGNCGCGTVNWRSCTCNSGKTVKKYHEVLQFEPGHIKRRGRAKTMALVDIQLDHHERCDCICSSRPPRYLEYMPMD

SEQ ID NO: 482 - protein, 1002 aa, Artificial Sequence
  VEGFR2-Fc
MQSKVLLAVALWLCVETRAASVGLPSVSLDLPRLSIQKDILTIKANTTLQITCRGQRDLDWLWPNNQSGSEQRVEVTECSDGLFCKTLTIPKVIGNDTGAYKCFYRETDLASVIYVYVQDYRSPFIASVSDQHGVVYITENKNKTVVIPCLGSISNLNVSLCARYPEKRFVPDGNRISWDSKKGFTIPSYMISYAGMVFCEAKINDESYQSIMYIVVVVGYRIYDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKPFVAFGSGMESLVEATVGERVRIPAKYLGYPPPEIKWYKNGIPLESNHTIKAGHVLTIMEVSERDTGNYTVILTNPISKEKQSHVVSLVVYVPPQIGEKSLISPVDSYQYGTTQTLTCTVYAIPPPHHIHWYWQLEEECANEPSHAVSVTNPYPCEEWRSVEDFQGGNKIEVNKNQFALIEGKNKTVSTLVIQAANVSALYKCEAVNKVGRGERVISFHVTRGPEITLQPDMQPTEQESVSLWCTADRSTFENLTWYKLGPQPLPIHVGELPTPVCKNLDTLWKLNATMFSNSTNDILIMELKNASLQDQGDYVCLAQDRKTKKRHCVVRQLTVLERVAPTITGNLENQTTSIGESIEVSCTASGNPPPQIMWFKDNETLVEDSGIVLKDGNRNLTIRRVRKEDEGLYTCQACSVLGCAKVEAFFIIEGAQEKTNLEGSGGSGEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 483 - DNA, 67 bp, Artificial Sequence
  Oligonucleotide primer
ctctccacaggtgtcctcgagaattcatataggccggccaccatgcggcttccgggtgcgatgccag

SEQ ID NO: 484 - DNA, 74 bp, Artificial Sequence
  Oligonucleotide primer
ggggtgggtacaaccccagagctgttttaaggcgcgcctctagattatttacccggagacagggagaggctctt

SEQ ID NO: 485 - DNA, 2289 bp, Artificial Sequence
  PDGFRbeta-Fc5 coding sequence
atgcggcttccgggtgcgatgccagctctggccctcaaaggcgagctgctgttgctgtctctcctgttacttctggaaccacagatctctcagggcctggtcgtcacacccccggggccagagcttgtcctcaatgtctccagcaccttcgttctgacctgctcgggttcagctccggtggtgtgggaacggatgtcccaggagcccccacaggaaatggccaaggcccaggatggcaccttctccagcgtgctcacactgaccaacctcactgggctagacacgggagaatacttttgcacccacaatgactcccgtggactggagaccgatgagcggaaacggctctacatctttgtgccagatcccaccgtgggcttcctccctaatgatgccgaggaactattcatctttctcacggaaataactgagatcaccattccatgccgagtaacagacccacagctggtggtgacactgcacgagaagaaaggggacgttgcactgcctgtcccctatgatcaccaacgtggcttttctggtatctttgaggacagaagctacatctgcaaaaccaccattggggacagggaggtggattctgatgcctactatgtctacagactccaggtgtcatccatcaacgtctctgtgaacgcagtgcagactgtggtccgccagggtgagaacatcaccctcatgtgcattgtgatcgggaatgaggtggtcaacttcgagtggacatacccccgcaaagaaagtgggcggctggtggagccggtgactgacttcctcttggatatgccttaccacatccgctccatcctgcacatccccagtgccgagttagaagactcggggacctacacctgcaatgtgacggagagtgtgaatgaccatcaggatgaaaaggccatcaacatcaccgtggttgagagcggctacgtgcggctcctgggagaggtgggcacactacaatttgctgagctgcatcggagccggacactgcaggtagtgttcgaggcctacccaccgcccactgtcctgtggttcaaagacaaccgcaccctgggcgactccagcgctggcgaaatcgccctgtccacgcgcaacgtgtcggagacccggtatgtgtcagagctgacactggttcgcgtgaaggtggcagaggctggccactacaccatgcgggccttccatgaggatgctgaggtccagctctccttccagctacagatcaatgtccctgtccgagtgctggagctaagtgagagccaccctgacagtggggaacagacagtccgctgtcgtggccggggcatgccccagccgaacatcatctggtctgcctgcagagacctcaaaaggtgtccacgtgagctgccgcccacgctgctggggaacagttccgaagaggagagccagctggagactaacgtgacgtactgggaggaggagcaggagtttgaggtggtgagcacactgcgtctgcagcacgtggatcggccactgtcggtgcgctgcacgctgcgcaacgctgtgggccaggacacgcaggaggtcatcgtggtgccacactccttgccctttgagcccaaatcttcagacaaaactcacacatgcccaccgtgcccagcacctgaagccgagggggcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccatcctccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaataa

SEQ ID NO: 486 - protein, 762 aa, Artificial Sequence
  PDGFRbeta-Fc5
MRLPGAMPALALKGELLLLSLLLLLEPQISQGLVVTPPGPELVLNVSSTFVLTCSGSAPVVWERMSQEPPQEMAKAQDGTFSSVLTLTNLTGLDTGEYFCTHNDSRGLETDERKRLYIFVPDPTVGFLPNDAEELFIFLTEITEITIPCRVTDPQLVVTLHEKKGDVALPVPYDHQRGFSGIFEDRSYICKTTIGDREVDSDAYYVYRLQVSSINVSVNAVQTVVRQGENITLMCIVIGNEVVNFEWTYPRKESGRLVEPVTDFLLDMPYHIRSILHIPSAELEDSGTYTCNVTESVNDHQDEKAINITVVESGYVRLLGEVGTLQFAELHRSRTLQVVFEAYPPPTVLWFKDNRTLGDSSAGEIALSTRNVSETRYVSELTLVRVKVAEAGHYTMRAFHEDAEVQLSFQLQINVPVRVLELSESHPDSGEQTVRCRGRGMPQPNIIWSACRDLKRCPRELPPTLLGNSSEEESQLETNVTYWEEEQEFEVVSTLRLQHVDRPLSVRCTLRNAVGQDTQEVIVVPHSLPFEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 487 - protein, 744 aa, Artificial Sequence [sequence omitted]

SEQ ID NO: 488 - protein, 241 aa, Homo sapien
MNRCWALFLSLCCYLRLVSAEGDPIPEELYEMLSDHSIRSFDDLQRLLHGDPGEEDGAELDLNMTRSHSGGELESLARGRRSLGSLTIAEPAMIAECKTRTEVFEISRRLIDRTNANFLVWPPCVEVQRCSGCCNNRNVQCRPTQVQLRPVQVRKIEIVRKKPIFKKATVTLEDHLACKCETVAAARPVTRSPGGSQEQRAKTPQTRVTIRTVRVRRPPKGKHRKFKHTHDKTALKETLGA

SEQ ID NO: 489 - DNA, 21 bp, Artificial Sequence
  Oligonucleotide primer
aggacttcctggagggggtga

SEQ ID NO: 490 - DNA, 21 bp, Artificial Sequence
  Oligonucleotide primer
gagcttcaggcagggcagggt

SEQ ID NO: 491 - DNA, 3431 bp, Cynomolgus Monkey
aggacttcctggagggggtgactgtccagagcctggaactctgcccacaccagaagccatcagcagcaaggacaccatgcggattccgggtgcgatgccagctctggccctcaaaggccagctgctgttgctgcccctgctgttactgctggaaccgcaggtctctcagggcctggtcatcacacccccggggccagagcttatcctcaatgtctccagcacctttgttctgacctgctcgggttcagctcccgtggtgtgggagcggatgtcccaggagctcccacaggaaatggccaaggcccaggacaataccttctccagtgtgctgacactgaccaacctcactgggctagacacgggagaatacttttgcacctacaatgactcccgtggactggagcctgatgagcggaaacggctctacatctttgtgccagatcccaccgtgggcttcctccctaatgacgccgaggaactattcatctttcttacggaaataactgagatcaccattccatgccgagtaacagacccacaactggtggtgacactgcacgagaagaaaggggacattgcactgcctgtcccctacgatcaccagcgtggcttttctggtatctttgaggacagaagctacatctgcaaaaccaccattggggacagggaggtggattccgacgcctactatgtctacagactccaggtgtcatccatcaacgtctccgtgaatgcagtgcagacggtggtccgccagggtgagaacattaccctcatgtgcattgtgatcgggaatgaggtggtcaacttcgagtggatgtacccccgcaaagaaagtgggcggctggtggagccggtgaccgacttcctcttggatatgccttaccacatccgctccatcctgcacatccccagtgccgagttagaagactcggggacctacacctgcaatgtgacagagagtgtgaatgaccatcaggatgaaaaggccatcaacatcactgtggttgagagtggctacgtgcggctcctgggagaggtgggagcactacaatttgctgagctgcaccggagccggacactgcaggtagtgttcgaggcctacccaccgcccaccgtcctgtggttcaaagacaaccgcaccttgggtgactccagcgcaggcgagatcgccctgtccacgcgcaacgtgtcagagaccaggtatgtgtcagagctgacactcgttcgggtgaaggtggcagaggctggccactacaccatgcgggccttccatgaggacgctgaggtccagctctccttccagctacagatcaatgtccctgtccgcgtgctggagctaagtgagagccacccagacagcggggaacagacagtccgctgtcgtggccggggcatgccccagccgaacatcatctggtctgcctgcagagacctcaaaaggtgtccacgcgagctgccgcccatgctgctggggaacagttctgaagaggagagccagctggagacgaacgtgacatactgggaggaggagcaggagtttgaggtggtgagcacactgcgtctgcagcacgtggatcggccactgtcggtgcgctgcacgctgcgcaacgctgtgggccaggacatgcaggaggtcatcgtggtgccacactctttgcccttcaaggcggtggtgatctcagccatcctggccctggtggtcctcaccatcatctcccttatcatcctcatcatgctttggcagaagaagccacgttacgagatccgatggaaggtgattgagtctgtgagctctgatggccatgagtacatctacgtggaccccatgcagctgccctatgactccacgtgggagctgccgcgggaccagcttgtgctgggacgcaccctcggctctggggcctttgggcaggtggtggaggccacggctcatggcctgagccattctcaggccacgatgaaagtggccgtcaagatgcttaaatccacagcccgcagcagtgagaagcaagccctcatgtcggagctgaagatcatgagtcaccttgggccccacctgaacgtggtcaacctgttgggggcctgcaccaaaggaggacccatctatatcatcactgagtactgccgctacggagacctggtggactacctgcaccgcaacaagcacacgttcctgcagcaccattccgacaagcgccgcccgcccagcgcggagctctacagcaatgcgctgcctgttgggctccccctgcccagccacgtgtccctgactggggagagcgatggtggctacatggacatgagcaaggacgagtcggtggactacgtgcccatgctggacatgaaaggagatgtaaaatatgccgacatcgagtcctccaactacatggccccctacgataactacgttccctctgcccctgagaggacctgtcgggcaactttaatcaatgagtctccggtgctaagctacatggaccttgtgggcttcagctaccaggtggccaatggcatggagttcctggcctccaagaactgcgtgcaccgagacctggcggccaggaacgtgctcatctgcgagggcaagctggtcaagatctgtgactttggcctggctcgagacatcatgcgggattcgaattacatctccaaaggcagtacctttttgcctttgaagtggatggctccagagagcatcttcaacagcctctacaccaccctgagcgacgtgtggtccttcgggatcctgctctgggagatcttcactttgggtggcaccccttacccagagctgcccatgaatgagcagttctacaatgccatcaaacggggttaccgcatggcccagcctgcccacgcctccgacgagatctatgagatcatgcagaagtgctgggaagagaagtttgagattcggccccctttctcccagctggtgcttcttctcgagagactgttgggcgaaggttacaaaaagaagtaccagcaggtggatgaggagtttctgaggagtgaccacccagccatccttcggtcccaggcccgcttgcctgggttccatggcctccgatctcccctggacagcagctccgtcctctataccgccgtgcagcccaatgagggtgacaacgactatatcatccccctgcctgaccccaaacccgaggttgctgacgagggcccactggagggttcccccagcctagccagctccaccctgaatgaagtcaacacctcctcgaccatctcctgtgacagccctctggagccccaggaggaaccagagccagagccccagcttgagcgccaggtggaaccagagccagagctggaacagctgccggattcagggtgccccgcgcctcgagcggaagcagaggacagcttcctgtagggggctggcccccaccctgccctgcctgaagctc

SEQ ID NO: 492 - protein, 232 aa, Artificial Sequence
  Effector function minus Fc (Fc5)
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 493 - DNA, 75 bp, Artificial Sequence
  (G4S) 5 Linker cDNA sequence
ggtggtggtggttctggcggcggcggctccggcgggggtggaagtggtggtggtggttctggtggtggtggttct

SEQ ID NO: 494 - protein, 25 aa, Artificial Sequence
  (G4S) 5 Linker
GGGGSGGGGSGGGGSGGGGSGGGGS

SEQ ID NO: 495 - DNA, 30 bp, Artificial Sequence
  (G4S)2 Linker and tether cDNA sequence
ggtggcgggggttcgggtggaggaggttct

SEQ ID NO: 496 - protein, 10 aa, Artificial Sequence
  (G4S)2 Linker and tether
GGGGSGGGGS

SEQ ID NO: 497 - DNA, 765 bp, Artificial Sequence
  c1111.1 scFv cDNA
gaagttcaattgttagagtctggtggcggtcttgttcagcctggtggttctttacgtctttcttgcgctgcttccggattcactttctcttggtacgatatggattgggttcgccaagctcctggtaaaggtttggagtgggtttctgttatctctccttctggtggctggactgcttatgctgactccgttaaaggtcgcttcactatctctagagacaactctaagaatactctctacttgcagatgaacagcttaagggctgaggacacggccgtgtattactgtgcgagagatagtagtggttattactcacctgatgcttttgatatctggggccaagggaccctggtcaccgtctcaagcgttggttctggaggttcaggtggtggcggctctggtggtggtggttctggtggcggtggttctggaggttcaggcggaaacatccagatgacccagtctccatcctccctgtctgcatctgtaggagacagagtcaccatcacttgccgggcaagtcagagcattagcagctatttaaattggtatcagcagaaaccagggaaagcccctaaactcctgatctatgatgcatccagtttgcaaagtggggtcccattaaggttcagtggcagtggatctgggacagatttcactctcaccatcagcagtctgcaacctgaagattttgcaacttactactgtcaacagagttacagtaccccgctcactttcggcggagggaccaaagtggatatcaaa

SEQ ID NO: 498 - protein, 255 aa, Artificial Sequence
  c1111.1 scFv
EVQLLESGGGLVQPGGSLRLSCAASGFTFSWYDMDWVRQAPGKGLEWVSVISPSGGWTAYADSVKGRFTISRDNSKNTLYLQMNSLRAEDTAVYYCARDSSGYYSPDAFDIWGQGTLVTVSSVGSGGSGGGGSGGGGSGGGGSGGSGGNIQMTQSPSSLSASVGDRVTITCRASQSISSYLNWYQQKPGKAPKLLIYDASSLQSGVPLRFSGSGSGTDFTLTISSLQPEDFATYYCQQSYSTPLTFGGGTKVDIK

SEQ ID NO: 499 - DNA, 744 bp, Artificial Sequence
  c870.1 scFv cDNA
gaagttcaattgttagagtctggtggcggtcttgttcagcctggtggttctttacgtctttcttgcgctgcttccggattcactttctctggttacattatgtggtgggttcgccaagctcctggtaaaggtttggagtgggtttctgttatctctccttctggtggcgatacttggtatgctgactccgttaaaggtcgcttcactatctctagagacaactctaagaatactctctacttacagatgaacagcttaagggctgaggacacggccgtgtattactgtgccacagcgggagactactggggccagggcaccctggtcaccgtctcaagcgttggttctggaggttcaggcggtggcggctctggtggtggtggttctggtggcggtggttctggaggttcaggcggacagagcgaattgactcagccaccctcagcgtctgggacccccgggcagagggtcaccatctcttgttctggaagcagctccaacatcggaaggaatcctgtaaactggtaccagcacctcccaggaacggcccccaaactcctcatctatggtgataatcagcggccctcaggggtccctgaccgattctctggctccaggtctggcacctcagcctccctggccatcagtgggctccagtctgaggatgaggctgattattactgtgcagcatgggatgacagcctgaatggtgtggtattcggcggagggaccaagctgaccgtc

SEQ ID NO: 500 - protein, 248 aa, Artificial Sequence
  c870.1 scFv
EVQLLESGGGLVQPGGSLRLSCAASGFTFSGYIMWWVRQAPGKGLEWVSVISPSGGDTWYADSVKGRFTISRDNSKNTLYLQMNSLRAEDTAVYYCATAGDYWGQGTLVTVSSVGSGGSGGGGSGGGGSGGGGSGGSGGQSELTQPPSASGTPGQRVTISCSGSSSNIGRNPVNWYQHLPGTAPKLLIYGDNQRPSGVPDRFSGSRSGTSASLAISGLQSEDEADYYCAAWDDSLNGVVFGGGTKLTV

SEQ ID NO: 501 - DNA, 762 bp, Artificial Sequence
  c1091.1 scFv cDNA
gaagttcaattgttagagtctggtggcggtcttgttcagcctggtggttctttacgtctttcttgcgctgcttccggattcactttctctaagtacgatatgcattgggttcgccaagctcctggtaaaggtttggagtgggtttctgttatctctccttctggtggctggacttcttatgctgactccgttaaaggtcgcttcactatctctagagacaactctaagaatactctctacttgcagatgaacagcttaagggctgaggacaccgccatgtattactgtgcgagggatgactacagtaaaggacgggatgcttttgatatctggggccaagggaccctggtcaccgtctcaagcgttggttctggaggttcaggtggtggcggctctggtggtggtggttctggtggcggtggttctggaggttcaggcggagacatccagttgacccagtctccatcttccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccgtacacttttggccaggggaccaagctggagatcaaa

SEQ ID NO: 502 - protein, 254 aa, Artificial Sequence
  c1092.1 scFv
EVQLLESGGGLVQPGGSLRLSCAASGFTFSKYDMHWVRQAPGKGLEWVSVISPSGGWTSYADSVKGRFTISRDNSKNTLYLQMNSLRAEDTAMYYCARDDYSKGRDAFDIWGQGTLVTVSSVGSGGSGGGGSGGGGSGGGGSGGSGGDIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIK

SEQ ID NO: 503 - DNA, 762 bp, Artificial Sequence
  c1039.1 scFv cDNA
gaagttcaattgttagagtctggtggcggtcttgttcagcctggtggttctttacgtctttcttgcgctgcttccggattcactttctcttggtacgatatggtttgggttcgccaagctcctggtaaaggtttggagtgggtttctgttatctctccttctggtggctggacttcttatgctgactccgttaaaggtcgcttcactatctctagagacaactctaagaatactctctacttgcagatgaacagcttaagggctgaggacacggccgtgtattactgtgcgagagatcatagtggctacgattctgaatactttgactactggggccagggcaccctggtcaccgtctcaagcgttggttctggaggttcaggcggtggcggctctggtggtggtggttctggtggcggtggttctggaggttcaggcggaaacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccgtacacttttggccaggggaccaagctggagatcaaa

SEQ ID NO: 504 - protein, 254 aa, Artificial Sequence
  c1039.1 scFv
EVQLLESGGGLVQPGGSLRLSCAASGFTFSWYDMVWVRQAPGKGLEWVSVISPSGGWTSYADSVKGRFTISRDNSKNTLYLQMNSLRAEDTAVYYCARDHSGYDSEYFDYWGQGTLVTVSSVGSGGSGGGGSGGGGSGGGGSGGSGGNIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIK

SEQ ID NO: 505 - DNA, 753 bp, Artificial Sequence
  c868.1 scFv cDNA
gccatccagatgacccagtctccatcctccctgtctgcatctgtaggagacagagtcaccatcacttgccgggcaagtcagagcattagcagctatttaaattggtatcagcagaaaccagggaaagcccctaaactcctgatccatgctgcatccaatttgcagagtggggtcccatcaaggttcagtggcagtggatctgggacagatttcactctcaccatcagcagtctgcaacctgaagattttgcaacttactactgtcaacagagttacagtacccctctcactttcggcggagggaccaaggtggagatcaagcttggttctggaggttcaggcggtggcggctctggtggtggtggttctggtggcggtggttctggaggttcaggcggagaagttcaattgttagagtctggtggcggtcttgttcagcctggtggttctttacgtctttcttgcgctgcttccggattcactttctctcattacgagatgggttgggttcgccaagctcctggtaaaggtttggagtgggtttcttatatctcttcttctggtggctggactgcttatgctgactccgttaaaggtcgcttcactatctctagagacaactctaagaatactctctacttgcagatgaacagcttaagggctgaggacacggccgtgtattactgtgcaaggattggctacgcagatgcttttgatatctggggccaagggaccacggtcaccgtctcaagc

SEQ ID NO: 506 - protein, 251 aa, Artificial Sequence
  c868.1 scFv
AIQMTQSPSSLSASVGDRVTITCRASQSISSYLNWYQQKPGKAPKLLIHAASNLQSGVPSRFSGSGSGTDFTLTISSLQPEDFATYYCQQSYSTPLTFGGGTKVEIKLGSGGSGGGGSGGGGSGGGGSGGSGGEVQLLESGGGLVQPGGSLRLSCAASGFTFSHYEMGWVRQAPGKGLEWVSYISSSGGWTAYADSVKGRFTISRDNSKNTLYLQMNSLRAEDTAVYYCARIGYADAFDIWGQGTTVTVSS

SEQ ID NO: 507 - DNA, 756 bp, Artificial Sequence
  c1081.1 scFv cDNA
gaagttcaattgttagagtctggtggcggtcttgttcagcctggtggttctttacgtctttcttgcgctgcttccggattcactttctctacttacgatatgcattgggttcgccaggctcctggtaaaggtttggagtgggtttctgttatctctccttctggtggctggactgcttatgctgactccgttaaaggtcgcttcactatctctagagacaactctaagaatactctctacttgcagatgaacagcttaagggctgaggacacggccgtgtattactgtgcaagagcagcagctggatatgatgcttttgatatctggggccaagggacaatggtcaccgtctcaagcgttggttctggaggttcaggcggtggcggctctggtggtggtggttctggtggcggtggttctggaggttcaggcggagaaattgtgttgacgcagtctccatcccccctgtctgcatctgtcggagacagagtcaccatcacttgccgggcaagtcacaacatcaacaaatatttaaattggtatcaacaaaaaccggggaaagcccctaagctcctgatctttggtgcatccagtttgcgcagtggggtcccatcaaggttcagtggcagtggatctggcacagatttcactctcactatcagcagtctggaacctgaggatttggcaacttacttctgtcaacagacttacaataccccgctcactttcggcggagggaccaagctggagatcaaa

SEQ ID NO: 508 - protein, 252 aa, Artificial Sequence
  c1081.1 scFv
EVQLLESGGGLVQPGGSLRLSCAASGFTFSTYDMHWVRQAPGKGLEWVSVISPSGGWTAYADSVKGRFTISRDNSKNTLYLQMNSLRAEDTAVYYCARAAAGYDAFDIWGQGTMVTVSSVGSGGSGGGGSGGGGSGGGGSGGSGGEIVLTQSPSPLSASVGDRVTITCRASHNINKYLNWYQQKPGKAPKLLIFGASSLRSGVPSRFSGSGSGTDFTLTISSLEPEDLATYFCQQTYNTPLTFGGGTKLEIK

SEQ ID NO: 509 - DNA, 1410 bp, Artificial Sequence
  c597.1 whole IgG1 cDNA
atgggatggagctgtatcatcctcttcttggtagcaacagctacaggcgcgcactccgaagttcaattgttagagtctggtggcggtcttgttcagcctggtggttctttacgtctttcttgcgctgcttccggattcactttctctaagtacaagatgctttgggttcgccaagctcctggtaaaggtttggagtgggtttcttctatctatccttctggtggcgttactttttatgctgactccgttaaaggtcgcttcactatctctagagacaactctaagaatactctctacttgcagatgaacagcttaagggctgaggacacggccgtgtattactgtgcaagagatggggagatgatttcgggtagtttctttgactcctggggccagggaaccctggtcaccgtctcaagcgcctccaccaagggcccatcggtcttcccgctagcaccctcctccaagagcacctctgggggcacagcggccctgggctgcctggtcaaggactacttccccgaaccggtgacggtgtcgtggaactcaggcgccctgaccagcggcgtccacaccttcccggctgtcctacagtcctccggactctactccctcagcagcgtagtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 510 - protein, 470 aa, Artificial Sequence
  c597.1 whole IgG1
MGWSCIILFLVATATGAHSEVQLLESGGGLVQPGGSLRLSCAASGFTFSKYKMLWVRQAPGKGLEWVSSIYPSGGVTFYADSVKGRFTISRDNSKNTLYLQMNSLRAEDTAVYYCARDGEMISGSFFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 511 - DNA, 2202 bp, Artificial Sequence
  c597.1-c1111.1 biAb 10mer linker IgG1 cDNA
atgggatggagctgtatcatcctcttcttggtagcaacagctacaggcgcgcactccgaagttcaattgttagagtctggtggcggtcttgttcagcctggtggttctttacgtctttcttgcgctgcttccggattcactttctctaagtacaagatgctttgggttcgccaagctcctggtaaaggtttggagtgggtttcttctatctatccttctggtggcgttactttttatgctgactccgttaaaggtcgcttcactatctctagagacaactctaagaatactctctacttgcagatgaacagcttaagggctgaggacacggccgtgtattactgtgcaagagatggggagatgatttcgggtagtttctttgactcctggggccagggaaccctggtcaccgtctcaagcgcctccaccaagggcccatcggtcttcccgctagcaccctcctccaagagcacctctgggggcacagcggccctgggctgcctggtcaaggactacttccccgaaccggtgacggtgtcgtggaactcaggcgccctgaccagcggcgtccacaccttcccggctgtcctacagtcctccggactctactccctcagcagcgtagtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtggtggcgggggttcgggtggaggaggttctgaagttcaattgttagagtctggtggcggtcttgttcagcctggtggttctttacgtctttcttgcgctgcttccggattcactttctcttggtacgatatggattgggttcgccaagctcctggtaaaggtttggagtgggtttctgttatctctccttctggtggctggactgcttatgctgactccgttaaaggtcgcttcactatctctagagacaactctaagaatactctctacttgcagatgaacagcttaagggctgaggacacggccgtgtattactgtgcgagagatagtagtggttattactcacctgatgcttttgatatctggggccaagggaccctggtcaccgtctcaagcgttggttctggaggttcaggtggtggcggctctggtggtggtggttctggtggcggtggttctggaggttcaggcggaaacatccagatgacccagtctccatcctccctgtctgcatctgtaggagacagagtcaccatcacttgccgggcaagtcagagcattagcagctatttaaattggtatcagcagaaaccagggaaagcccctaaactcctgatctatgatgcatccagtttgcaaagtggggtcccattaaggttcagtggcagtggatctgggacagatttcactctcaccatcagcagtctgcaacctgaagattttgcaacttactactgtcaacagagttacagtaccccgctcactttcggcggagggaccaaagtggatatcaaa

SEQ ID NO: 512 - protein, 734 aa, Artificial Sequence
  c597.1-c1111.1 biAb 10mer linker IgG1
MGWSCIILFLVATATGAHSEVQLLESGGGLVQPGGSLRLSCAASGFTFSKYKMLWVRQAPGKGLEWVSSIYPSGGVTFYADSVKGRFTISRDNSKNTLYLQMNSLRAEDTAVYYCARDGEMISGSFFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSEVQLLESGGGLVQPGGSLRLSCAASGFTFSWYDMDWVRQAPGKGLEWVSVISPSGGWTAYADSVKGRFTISRDNSKNTLYLQMNSLRAEDTAVYYCARDSSGYYSPDAFDIWGQGTLVTVSSVGSGGSGGGGSGGGGSGGGGSGGSGGNIQMTQSPSSLSASVGDRVTITCRASQSISSYLNWYQQKPGKAPKLLIYDASSLQSGVPLRFSGSGSGTDFTLTISSLQPEDFATYYCQQSYSTPLTFGGGTKVDIK

SEQ ID NO: 513 - DNA, 2181 bp, Artificial Sequence
  c597.1-c870.1 biAb 10mer linker IgG1 cDNA
atgggatggagctgtatcatcctcttcttggtagcaacagctacaggcgcgcactccgaagttcaattgttagagtctggtggcggtcttgttcagcctggtggttctttacgtctttcttgcgctgcttccggattcactttctctaagtacaagatgctttgggttcgccaagctcctggtaaaggtttggagtgggtttcttctatctatccttctggtggcgttactttttatgctgactccgttaaaggtcgcttcactatctctagagacaactctaagaatactctctacttgcagatgaacagcttaagggctgaggacacggccgtgtattactgtgcaagagatggggagatgatttcgggtagtttctttgactcctggggccagggaaccctggtcaccgtctcaagcgcctccaccaagggcccatcggtcttcccgctagcaccctcctccaagagcacctctgggggcacagcggccctgggctgcctggtcaaggactacttccccgaaccggtgacggtgtcgtggaactcaggcgccctgaccagcggcgtccacaccttcccggctgtcctacagtcctccggactctactccctcagcagcgtagtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtggtggcgggggttcgggtggaggaggttctgaagttcaattgttagagtctggtggcggtcttgttcagcctggtggttctttacgtctttcttgcgctgcttccggattcactttctctggttacattatgtggtgggttcgccaagctcctggtaaaggtttggagtgggtttctgttatctctccttctggtggcgatacttggtatgctgactccgttaaaggtcgcttcactatctctagagacaactctaagaatactctctacttacagatgaacagcttaagggctgaggacacggccgtgtattactgtgccacagcgggagactactggggccagggcaccctggtcaccgtctcaagcgttggttctggaggttcaggcggtggcggctctggtggtggtggttctggtggcggtggttctggaggttcaggcggacagagcgaattgactcagccaccctcagcgtctgggacccccgggcagagggtcaccatctcttgttctggaagcagctccaacatcggaaggaatcctgtaaactggtaccagcacctcccaggaacggcccccaaactcctcatctatggtgataatcagcggccctcaggggtccctgaccgattctctggctccaggtctggcacctcagcctccctggccatcagtgggctccagtctgaggatgaggctgattattactgtgcagcatgggatgacagcctgaatggtgtggtattcggcggagggaccaagctgaccgtc

SEQ ID NO: 514 - protein, 727 aa, Artificial Sequence
  c597.1-c870.1 biAb 10mer linker IgG1
MGWSCIILFLVATATGAHSEVQLLESGGGLVQPGGSLRLSCAASGFTFSKYKMLWVRQAPGKGLEWVSSIYPSGGVTFYADSVKGRFTISRDNSKNTLYLQMNSLRAEDTAVYYCARDGEMISGSFFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSEVQLLESGGGLVQPGGSLRLSCAASGFTFSGYIMWWVRQAPGKGLEWVSVISPSGGDTWYADSVKGRFTISRDNSKNTLYLQMNSLRAEDTAVYYCATAGDYWGQGTLVTVSSVGSGGSGGGGSGGGGSGGGGSGGSGGQSELTQPPSASGTPGQRVTISCSGSSSNIGRNPVNWYQHLPGTAPKLLIYGDNQRPSGVPDRFSGSRSGTSASLAISGLQSEDEADYYCAAWDDSLNGVVFGGGTKLTV

SEQ ID NO: 515 - DNA, 2199 bp, Artificial Sequence
  c597.1-c1092.1 biAb 10mer linker IgG1 cDNA
atgggatggagctgtatcatcctcttcttggtagcaacagctacaggcgcgcactccgaagttcaattgttagagtctggtggcggtcttgttcagcctggtggttctttacgtctttcttgcgctgcttccggattcactttctctaagtacaagatgctttgggttcgccaagctcctggtaaaggtttggagtgggtttcttctatctatccttctggtggcgttactttttatgctgactccgttaaaggtcgcttcactatctctagagacaactctaagaatactctctacttgcagatgaacagcttaagggctgaggacacggccgtgtattactgtgcaagagatggggagatgatttcgggtagtttctttgactcctggggccagggaaccctggtcaccgtctcaagcgcctccaccaagggcccatcggtcttcccgctagcaccctcctccaagagcacctctgggggcacagcggccctgggctgcctggtcaaggactacttccccgaaccggtgacggtgtcgtggaactcaggcgccctgaccagcggcgtccacaccttcccggctgtcctacagtcctccggactctactccctcagcagcgtagtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtggtggcgggggttcgggtggaggaggttctgaagttcaattgttagagtctggtggcggtcttgttcagcctggtggttctttacgtctttcttgcgctgcttccggattcactttctctaagtacgatatgcattgggttcgccaagctcctggtaaaggtttggagtgggtttctgttatctctccttctggtggctggacttcttatgctgactccgttaaaggtcgcttcactatctctagagacaactctaagaatactctctacttgcagatgaacagcttaagggctgaggacaccgccatgtattactgtgcgagggatgactacagtaaaggacgggatgcttttgatatctggggccaagggaccctggtcaccgtctcaagcgttggttctggaggttcaggtggtggcggctctggtggtggtggttctggtggcggtggttctggaggttcaggcggagacatccagttgacccagtctccatcttccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccgtacacttttggccaggggaccaagctggagatcaaa

SEQ ID NO: 516 - protein, 733 aa, Artificial Sequence
  c597.1-c1092.1 biAb 10mer linker IgG1
MGWSCIILFLVATATGAHSEVQLLESGGGLVQPGGSLRLSCAASGFTFSKYKMLWVRQAPGKGLEWVSSIYPSGGVTFYADSVKGRFTISRDNSKNTLYLQMNSLRAEDTAVYYCARDGEMISGSFFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSEVQLLESGGGLVQPGGSLRLSCAASGFTFSKYDMHWVRQAPGKGLEWVSVISPSGGWTSYADSVKGRFTISRDNSKNTLYLQMNSLRAEDTAMYYCARDDYSKGRDAFDIWGQGTLVTVSSVGSGGSGGGGSGGGGSGGGGSGGSGGDIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIK

SEQ ID NO: 517 - DNA, 2199 bp, Artificial Sequence
  c597.1-c1039.1 biAb 10mer linker iGg1 Cdna
atgggatggagctgtatcatcctcttcttggtagcaacagctacaggcgcgcactccgaagttcaattgttagagtctggtggcggtcttgttcagcctggtggttctttacgtctttcttgcgctgcttccggattcactttctctaagtacaagatgctttgggttcgccaagctcctggtaaaggtttggagtgggtttcttctatctatccttctggtggcgttactttttatgctgactccgttaaaggtcgcttcactatctctagagacaactctaagaatactctctacttgcagatgaacagcttaagggctgaggacacggccgtgtattactgtgcaagagatggggagatgatttcgggtagtttctttgactcctggggccagggaaccctggtcaccgtctcaagcgcctccaccaagggcccatcggtcttcccgctagcaccctcctccaagagcacctctgggggcacagcggccctgggctgcctggtcaaggactacttccccgaaccggtgacggtgtcgtggaactcaggcgccctgaccagcggcgtccacaccttcccggctgtcctacagtcctccggactctactccctcagcagcgtagtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtggtggcgggggttcgggtggaggaggttctgaagttcaattgttagagtctggtggcggtcttgttcagcctggtggttctttacgtctttcttgcgctgcttccggattcactttctcttggtacgatatggtttgggttcgccaagctcctggtaaaggtttggagtgggtttctgttatctctccttctggtggctggacttcttatgctgactccgttaaaggtcgcttcactatctctagagacaactctaagaatactctctacttgcagatgaacagcttaagggctgaggacacggccgtgtattactgtgcgagagatcatagtggctacgattctgaatactttgactactggggccagggcaccctggtcaccgtctcaagcgttggttctggaggttcaggcggtggcggctctggtggtggtggttctggtggcggtggttctggaggttcaggcggaaacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccgtacacttttggccaggggaccaagctggagatcaaa

SEQ ID NO: 518 - protein, 733 aa, Artificial Sequence
  c597.1-c1039.1 biAb 10mer linker IgG1 amino acdid
MGWSCIILFLVATATGAHSEVQLLESGGGLVQPGGSLRLSCAASGFTFSKYKMLWVRQAPGKGLEWVSSIYPSGGVTFYADSVKGRFTISRDNSKNTLYLQMNSLRAEDTAVYYCARDGEMISGSFFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSEVQLLESGGGLVQPGGSLRLSCAASGFTFSWYDMVWVRQAPGKGLEWVSVISPSGGWTSYADSVKGRFTISRDNSKNTLYLQMNSLRAEDTAVYYCARDHSGYDSEYFDYWGQGTLVTVSSVGSGGSGGGGSGGGGSGGGGSGGSGGNIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIK

SEQ ID NO: 519 - DNA, 2190 bp, Artificial Sequence
  c597.1-c868.1 biAb 10mer linker IgG1 cDNA
atgggatggagctgtatcatcctcttcttggtagcaacagctacaggcgcgcactccgaagttcaattgttagagtctggtggcggtcttgttcagcctggtggttctttacgtctttcttgcgctgcttccggattcactttctctaagtacaagatgctttgggttcgccaagctcctggtaaaggtttggagtgggtttcttctatctatccttctggtggcgttactttttatgctgactccgttaaaggtcgcttcactatctctagagacaactctaagaatactctctacttgcagatgaacagcttaagggctgaggacacggccgtgtattactgtgcaagagatggggagatgatttcgggtagtttctttgactcctggggccagggaaccctggtcaccgtctcaagcgcctccaccaagggcccatcggtcttcccgctagcaccctcctccaagagcacctctgggggcacagcggccctgggctgcctggtcaaggactacttccccgaaccggtgacggtgtcgtggaactcaggcgccctgaccagcggcgtccacaccttcccggctgtcctacagtcctccggactctactccctcagcagcgtagtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtggtggcgggggttcgggtggaggaggttctgccatccagatgacccagtctccatcctccctgtctgcatctgtaggagacagagtcaccatcacttgccgggcaagtcagagcattagcagctatttaaattggtatcagcagaaaccagggaaagcccctaaactcctgatccatgctgcatccaatttgcagagtggggtcccatcaaggttcagtggcagtggatctgggacagatttcactctcaccatcagcagtctgcaacctgaagattttgcaacttactactgtcaacagagttacagtacccctctcactttcggcggagggaccaaggtggagatcaagcttggttctggaggttcaggcggtggcggctctggtggtggtggttctggtggcggtggttctggaggttcaggcggagaagttcaattgttagagtctggtggcggtcttgttcagcctggtggttctttacgtctttcttgcgctgcttccggattcactttctctcattacgagatgggttgggttcgccaagctcctggtaaaggtttggagtgggtttcttatatctcttcttctggtggctggactgcttatgctgactccgttaaaggtcgcttcactatctctagagacaactctaagaatactctctacttgcagatgaacagcttaagggctgaggacacggccgtgtattactgtgcaaggattggctacgcagatgcttttgatatctggggccaagggaccacggtcaccgtctcaagc

SEQ ID NO: 520 - protein, 730 aa, Artificial Sequence
  c597.1-c868.1 biAb 10mer linker IgG1
MGWSCIILFLVATATGAHSEVQLLESGGGLVQPGGSLRLSCAASGFTFSKYKMLWVRQAPGKGLEWVSSIYPSGGVTFYADSVKGRFTISRDNSKNTLYLQMNSLRAEDTAVYYCARDGEMISGSFFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSAIQMTQSPSSLSASVGDRVTITCRASQSISSYLNWYQQKPGKAPKLLIHAASNLQSGVPSRFSGSGSGTDFTLTISSLQPEDFATYYCQQSYSTPLTFGGGTKVEIKLGSGGSGGGGSGGGGSGGGGSGGSGGEVQLLESGGGLVQPGGSLRLSCAASGFTFSHYEMGWVRQAPGKGLEWVSYISSSGGWTAYADSVKGRFTISRDNSKNTLYLQMNSLRAEDTAVYYCARIGYADAFDIWGQGTTVTVSS

SEQ ID NO: 521 - DNA, 2193 bp, Artificial Sequence
  c597.1-c1081.1 biAb 10mer linker IgG1 cDNA
atgggatggagctgtatcatcctcttcttggtagcaacagctacaggcgcgcactccgaagttcaattgttagagtctggtggcggtcttgttcagcctggtggttctttacgtctttcttgcgctgcttccggattcactttctctaagtacaagatgctttgggttcgccaagctcctggtaaaggtttggagtgggtttcttctatctatccttctggtggcgttactttttatgctgactccgttaaaggtcgcttcactatctctagagacaactctaagaatactctctacttgcagatgaacagcttaagggctgaggacacggccgtgtattactgtgcaagagatggggagatgatttcgggtagtttctttgactcctggggccagggaaccctggtcaccgtctcaagcgcctccaccaagggcccatcggtcttcccgctagcaccctcctccaagagcacctctgggggcacagcggccctgggctgcctggtcaaggactacttccccgaaccggtgacggtgtcgtggaactcaggcgccctgaccagcggcgtccacaccttcccggctgtcctacagtcctccggactctactccctcagcagcgtagtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtggtggcgggggttcgggtggaggaggttctgaagttcaattgttagagtctggtggcggtcttgttcagcctggtggttctttacgtctttcttgcgctgcttccggattcactttctctacttacgatatgcattgggttcgccaggctcctggtaaaggtttggagtgggtttctgttatctctccttctggtggctggactgcttatgctgactccgttaaaggtcgcttcactatctctagagacaactctaagaatactctctacttgcagatgaacagcttaagggctgaggacacggccgtgtattactgtgcaagagcagcagctggatatgatgcttttgatatctggggccaagggacaatggtcaccgtctcaagcgttggttctggaggttcaggcggtggcggctctggtggtggtggttctggtggcggtggttctggaggttcaggcggagaaattgtgttgacgcagtctccatcccccctgtctgcatctgtcggagacagagtcaccatcacttgccgggcaagtcacaacatcaacaaatatttaaattggtatcaacaaaaaccggggaaagcccctaagctcctgatctttggtgcatccagtttgcgcagtggggtcccatcaaggttcagtggcagtggatctggcacagatttcactctcactatcagcagtctggaacctgaggatttggcaacttacttctgtcaacagacttacaataccccgctcactttcggcggagggaccaagctggagatcaaa

SEQ ID NO: 522 - protein, 731 aa, Artificial Sequence
  c597.1-c1081.1 biAb 10mer linker IgG1
MGWSCIILFLVATATGAHSEVQLLESGGGLVQPGGSLRLSCAASGFTFSKYKMLWVRQAPGKGLEWVSSIYPSGGVTFYADSVKGRFTISRDNSKNTLYLQMNSLRAEDTAVYYCARDGEMISGSFFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSEVQLLESGGGLVQPGGSLRLSCAASGFTFSTYDMHWVRQAPGKGLEWVSVISPSGGWTAYADSVKGRFTISRDNSKNTLYLQMNSLRAEDTAVYYCARAAAGYDAFDIWGQGTMVTVSSVGSGGSGGGGSGGGGSGGGGSGGSGGEIVLTQSPSPLSASVGDRVTITCRASHNINKYLNWYQQKPGKAPKLLIFGASSLRSGVPSRFSGSGSGTDFTLTISSLEPEDLATYFCQQTYNTPLTFGGGTKLEIK

SEQ ID NO: 523 - DNA, 54 bp, Artificial Sequence
  Oligonucleotide primer
atctccaaagccaaagggcagccccgagaaccacaggtgtacaccctgccccca

SEQ ID NO: 524 - DNA, 48 bp, Artificial Sequence
  Oligonucleotide primer
ggtggcgggggttcgggtggaggaggttctgaagttcaattgttagag

SEQ ID NO: 525 - DNA, 48 bp, Artificial Sequence
  Oligonucleotide primer
agaacctcctccacccgaacccccgccaccacccggagacagggagag

SEQ ID NO: 526 - DNA, 51 bp, Artificial Sequence
  Oligonucleotide primer
agtcgaggctgatcagcgagcttctagattttatttgatatccactttggt

SEQ ID NO: 527 - DNA, 52 bp, Artificial Sequence
  Oligonucleotide primer
agtcgaggctgatcagcgagcttctagattttagacggtcagcttggtccct

SEQ ID NO: 528 - DNA, 51 bp, Artificial Sequence
  Oligonucleotide primer
agtcgaggctgatcagcgagcttctagattttatttgatctccagcttggt

SEQ ID NO: 529 - DNA, 51 bp, Artificial Sequence
  Oligonucleotide primer
agtcgaggctgatcagcgagcttctagattttagcttgagacggtgaccgt

SEQ ID NO: 530 - DNA, 48 bp, Artificial Sequence
  Oligonucleotide primer
ggtggcgggggttcgggtggaggaggttctgccatccagatgacccag

SEQ ID NO: 531 - protein, 232 aa, Homo sapien
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 532 - protein, 232 aa, Artificial Sequence
  Fc-488
EPRSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 533 - protein, 232 aa, Artificial Sequence
  Fc-4
EPRSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 534 - protein, 231 aa, Artificial Sequence
  Fc6
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 535 - protein, 232 aa, Artificial Sequence
  Fc7
EPKSCDKTHTCPPCPAPELLGGPSVFLFPPKPKDTLMISRTPEVTCVVVDVSHEDPEVKFNWYVDGVEVHNAKTKPREEQYESTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 536 - DNA, 717 bp, Artificial
  c597.1 kappa chain cDNA
atgggatggagctgtatcatcctcttcttggtagcaacagctacaggcgtgcactctgacatccagatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtacacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 537 - protein, 239 aa, Artificial Sequence
  c597.1 kappa chain
MGWSCIILFLVATATGVHSDIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 538 - protein, 17 aa, Homo sapien
VISPSGGWTSYADSVKG

SEQ ID NO: 539 - protein, 15 aa, Artificial Sequence
  peptide linker
GGGGSGGGGSGGGGS

SEQ ID NO: 540 - protein, 17 aa, Artificial Sequence
  peptide linker
  MISC_FEATURE (2)..(5): Xaa is Gly or is absent
  MISC_FEATURE (6)..(6): Xaa is any naturally occurring amino acid
  MISC_FEATURE (8)..(11): Xaa is Gly or is absent
  MISC_FEATURE (12)..(12): Xaa is any naturally occurring amino acid
  MISC_FEATURE (14)..(17): Xaa is Gly or is absent
GXXXXXGXXXXXGXXXX

SEQ ID NO: 541 - protein, 11 aa, Artificial Sequence
  Peptide linker
  MISC_FEATURE (4)..(4): Xaa is any naturally occurring amino acid
  MISC_FEATURE (8)..(8): Xaa is any naturally occurring amino acid
GGGXGGGXGGG

SEQ ID NO: 542 - protein, 25 aa, Artificial Sequence
  peptide linker
  MISC_FEATURE (2)..(12): Xaa is Gly or is absent
  MISC_FEATURE (15)..(25): Xaa is Gly or is absent
GXXXXXXXXXXXCGXXXXXXXXXXX

SEQ ID NO: 543 - protein, 11 aa, Artificial Sequence
  peptide linker
GGGGGCGGGGG

SEQ ID NO: 544 - protein, 13 aa, Artificial
  VEGF-A Peptide
HEVVKFMDVYQRS

SEQ ID NO: 545 - protein, 13 aa, Artificial
  VEGF-A Peptide
VVKFMDVYQRSYS

SEQ ID NO: 546 - protein, 13 aa, Artificial
  VEGF-A Peptide
KFMDVYQRSYSHP

SEQ ID NO: 547 - protein, 13 aa, Artificial
  VEGF-A Peptide
MDVYQRSYSHPIE

SEQ ID NO: 548 - protein, 13 aa, Artificial
  VEGF-A Peptide
VYQRSYSHPIETL

SEQ ID NO: 549 - protein, 13 aa, Artificial
  VEGF-A Peptide
DIFQEYPDEIEYI

SEQ ID NO: 550 - protein, 13 aa, Artificial
  VEGF-A Peptide
FQEYPDEIEYIFK

SEQ ID NO: 551 - protein, 13 aa, Artificial
  VEGF-A Peptide
EYPDEIEYIFKPS

SEQ ID NO: 552 - protein, 13 aa, Artificial
  VEGF-A Peptide
EYIFKPSSVPLMR

SEQ ID NO: 553 - protein, 13 aa, Artificial
  VEGF-A Peptide
IFKPSSVPLMRSG

SEQ ID NO: 554 - protein, 13 aa, Artificial
  VEGF-A Peptide
LESVPTEESNITM

SEQ ID NO: 555 - protein, 13 aa, Artificial
  VEGF-A Peptide
PTEESNITMQIMR

SEQ ID NO: 556 - protein, 13 aa, Artificial
  VEGF-A Peptide
EESNITMQIMRIK

SEQ ID NO: 557 - protein, 13 aa, Artificial
  VEGF-A Peptide
SNITMQIMRIKPH

SEQ ID NO: 558 - protein, 13 aa, Artificial
  VEGF-A Peptide
ITMQIMRIKPHQG

SEQ ID NO: 559 - protein, 13 aa, Artificial
  VEGF-A Peptide
IMRIKPHQGQHIG

SEQ ID NO: 560 - protein, 13 aa, Artificial
  VEGF-A Peptide
PSGPSSERRKHLF

SEQ ID NO: 561 - protein, 13 aa, Artificial
  VEGF-A Peptide
GPSSERRKHLFVQ

SEQ ID NO: 562 - protein, 13 aa, Artificial
  VEGF-A Peptide
ARQLELNERTSRS

SEQ ID NO: 563 - protein, 13 aa, Artificial
  VEGF-A Peptide
QLELNERTSRSDK

SEQ ID NO: 564 - protein, 13 aa, Artificial
  VEGF-A Peptide
ELNERTSRSDKPR

SEQ ID NO: 565 - protein, 13 aa, Artificial
  VEGF-A Peptide
LNERTSRSDKPRR

SEQ ID NO: 566 - protein, 20 aa, Artificial
  PDGFRbeta Peptide
RSYISKTTIGDREVDSDAYY

SEQ ID NO: 567 - protein, 20 aa, Artificial
  PDGFRbeta Peptide
KTTIGDREVDSDAYYVYRLQ

SEQ ID NO: 568 - protein, 20 aa, Artificial
  PDGFRbeta Peptide
DREVDSDAYYVYRLQVSSIN

SEQ ID NO: 569 - protein, 20 aa, Artificial
  PDGFRbeta Peptide
RKESGRLVEPVTDFLLDMPY

SEQ ID NO: 570 - protein, 20 aa, Artificial
  PDGFRbeta Peptide
HRSRTLQVVFEAYPPPTVLW

SEQ ID NO: 571 - protein, 20 aa, Artificial
  PDGFRbeta Peptide
LLLLLEPQISQGLVVTPPGP

SEQ ID NO: 572 - protein, 20 aa, Artificial
  PDGFRbeta Peptide
EPQISQGLVVTPPGPELVLN

SEQ ID NO: 573 - protein, 20 aa, Artificial
  PDGFRbeta peptide
QGLVVTPPGPELVLNVSSTF

SEQ ID NO: 574 - protein, 20 aa, Artificial
  PDGFRbeta Peptide
VLTSSGSAPVVWERMSQEPP

SEQ ID NO: 575 - protein, 20 aa, Artificial
  PDGFRbeta Peptide
GSAPVVWERMSQEPPQEMAK

SEQ ID NO: 576 - protein, 20 aa, Artificial
  PDGFRbeta Peptide
DERKRLYIFVPDPTVGFLPN

SEQ ID NO: 577 - protein, 20 aa, Artificial
  PDGFRbeta Peptide
LYIFVPDPTVGFLPNDAEEL

SEQ ID NO: 578 - protein, 20 aa, Artificial
  PDGFRbeta Peptide
VPYDHQRGFSGIFEDRSYIS

SEQ ID NO: 579 - protein, 9 aa, Artificial
  VEGF-A peptide
KFMDVYQRS

SEQ ID NO: 580 - protein, 11 aa, Artificial
  VEGF-A peptide
IFKPSSVPLMR

SEQ ID NO: 581 - protein, 9 aa, Artificial
  VEGF-A peptide
IMRIKPHQG

SEQ ID NO: 582 - protein, 11 aa, Artificial
  VEGF-A peptide
GPSSERRKHLF

SEQ ID NO: 583 - protein, 10 aa, Artificial
  PDGFRbeta peptide
DREVDSDAYY

SEQ ID NO: 584 - DNA, 36 bp, Artificial
  Oligonucleotide primer zc24945
gagcccaaatcttcagacaaaactcacacatgccca

SEQ ID NO: 585 - DNA, 71 bp, Artificial
  Oligonucleotide primer zc56626
actttgcctttctctccacaggtgtccagggaattcatataggccggccaccatgggatggagctggatct

SEQ ID NO: 586 - DNA, 75 bp, Artificial
  Oligonucleotide primer zc56626
accaccaccaccacttccacccccgccggagccgccgccgccagaaccaccaccaccgcttgagacggtgaccag

SEQ ID NO: 587 - DNA, 69 bp, Artificial
  Oligonucleotide primer zc60139
ggctccggcgggggtggaagtggtggtggtggttctggtggtggtggttctgaagttcaattgttagag

SEQ ID NO: 588 - DNA, 75 bp, Artificial
  Oligonucleotide primer zc60427
atgggatggagctggatctttctctttcttctgtcaggaactgcaggtgtcctctctgaagttcaattgttagag

SEQ ID NO: 589 - DNA, 48 bp, Artificial
  Oligonucleotide primer zc60496
tgtgtgagttttgtctgaagatttgggctctttgatttccaccttggt

SEQ ID NO: 590 - DNA, 69 bp, Artificial
  Oligonucleotide primer zc60500
ggctccggcgggggtggaagtggtggtggtggttctggtggtggtggttctaacatccagatgacccag

SEQ ID NO: 591 - DNA, 75 bp, Artificial
  Oligonucleotide primer zc61436
accaccaccaccacttccacccccgccggagccgccgccgccagaaccaccaccaccgcttgagacggtgaccat

SEQ ID NO: 592 - DNA, 69 bp, Artificial
  Oligonucleotide primer zc61437
ggctccggcgggggtggaagtggtggtggtggttctggtggtggtggttctgccatccagttgacccag

SEQ ID NO: 593 - DNA, 48 bp, Artificial; identical to SEQ ID NO: 530
  Oligonucleotide primer zc61438

SEQ ID NO: 594 - DNA, 75 bp, Artificial
  Oligonucleotide primer zc61439
accaccaccaccacttccacccccgccggagccgccgccgccagaaccaccaccacccttgatctccaccttggt

SEQ ID NO: 595 - DNA, 69 bp, Artificial
  Oligonucleotide primer zc61440
ggctccggcgggggtggaagtggtggtggtggttctggtggtggtggttctcagagcgaattgactcag

SEQ ID NO: 596 - DNA, 69 bp, Artificial
  (Oligonucleotide primer zc61443)
ggctccggcgggggtggaagtggtggtggtggttctggtggtggtggttctgccatccagatgacccag

SEQ ID NO: 597 - DNA, 48 bp, Artificial
  Oligonucleotide primer zc61444
tgtgtgagttttgtctgaagatttgggctctttaatctccagtcgtgt

SEQ ID NO: 598 - DNA, 52 bp, Artificial
  Oligonucleotide primer zc61445
cccagagctgttttaaggcgcgcctctagatttagcttgagacggtgaccgt

SEQ ID NO: 599 - DNA, 52 bp, Artificial
  Oligonucleotide primer zc61447
cccagagctgttttaaggcgcgcctctagatttataggacggtcagcttggt

SEQ ID NO: 600 - DNA, 52 bp, Artificial
  Oligonucleotide primer zc61448
cccagagctgttttaaggcgcgcctctagatttatttgatctccagcttggt

SEQ ID NO: 601 - DNA, 45 bp, Artificial
  Oligonucleotide primer zc62580
ccatcggtcttcccgctagcaccctcctccaagagcacctctggg

SEQ ID NO: 602 - DNA, 51 bp, Artificial
  Oligonucleotide primer zc62593
agtcgaggctgatcagcgagcttctagattttataggacggtcagcttggt

SEQ ID NO: 603 - DNA, 780 bp, Artificial
  c941.1 scFv cDNA
gaagttcaattgttagagtctggtggcggtcttgttcagcctggtggttctttacgtctttcttgcgctgcttccggattcactttctctaagtacaagatgcagtgggttcgccaagctcctggtaaaggtttggagtgggtttcttctatctctccttctggtggccttactttttatgctgactccgttaaaggtcgcttcactatctctagagacaactctaagaatactctctacttgcagatgaacagcttaagggctgaggacacggccgtgtattactgtgcgaaagcccgtcggatgagaagcctatgggaggcttttgatatctggggccaagggacaatggtcaccgtctcaagcggtggtggtggttctggcggcggcggctccggcgggggtggaagtggtggtggtggttctggtggtggtggttctgccatccagttgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttaccgggcatctacccgggaatccggggtccctgaccgattcagtggcagcgggtctgggacagatttcactctcaccatcagcagcctgcaggctgaagatgtggcagtttattactgtcagcaatattatagtaccccgtggacgttcggccaagggaccaaggtggaaatcaaa

SEQ ID NO: 604 - protein, 260 aa, Artificial
  c941.1 scFv
EVQLLESGGGLVQPGGSLRLSCAASGFTFSKYKMQWVRQAPGKGLEWVSSISPSGGLTFYADSVKGRFTISRDNSKNTLYLQMNSLRAEDTAVYYCAKARRMRSLWEAFDIWGQGTMVTVSSGGGGSGGGGSGGGGSGGGGSGGGGSAIQLTQSPDSLAVSLGERATINCKSSQSVLYSSNNKNYLAWYQQKPGQPPKLLIYRASTRESGVPDRFSGSGSGTDFTLTISSLQAEDVAVYYCQQYYSTPWTFGQGTKVEIK

SEQ ID NO: 605 - DNA, 780 bp, Artificial
  c1035.1 scFv cDNA
gaagttcaattgttagagtctggtggcggtcttgttcagcctggtggttctttacgtctttcttgcgctgcttccggattcactttctctatgtactttatgtcttgggttcgccaagctcctggtaaaggtttggagtgggtttctggtatctctccttctggtggcatgactttttatgctgactccgttaaaggtcgcttcactatctctagagacaactctaagaatactctctacttgcagatgaacagcttaagggctgaggacacggccgtgtattactgtgcaaaagatggcatccccctatctatagctgcgccgattgactactggggccaggggaccctggtcaccgtctcaagcggtggtggtggttctggcggcggcggctccggcgggggtggaagtggtggtggtggttctggtggtggtggttctgccatccagatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcccatcaccttcggccaagggacacgactggagattaaa

SEQ ID NO: 606 - protein, 260 aa, Artificial
  c1035.1 scFv
EVQLLESGGGLVQPGGSLRLSCAASGFTFSMYFMSWVRQAPGKGLEWVSGISPSGGMTFYADSVKGRFTISRDNSKNTLYLQMNSLRAEDTAVYYCAKDGIPLSIAAPIDYWGQGTLVTVSSGGGGSGGGGSGGGGSGGGGSGGGGSAIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPITFGQGTRLEIK

SEQ ID NO: 607 - DNA, 750 bp, Artificial
  c868.1 scFv cDNA
gccatccagatgacccagtctccatcctccctgtctgcatctgtaggagacagagtcaccatcacttgccgggcaagtcagagcattagcagctatttaaattggtatcagcagaaaccagggaaagcccctaaactcctgatccatgctgcatccaatttgcagagtggggtcccatcaaggttcagtggcagtggatctgggacagatttcactctcaccatcagcagtctgcaacctgaagattttgcaacttactactgtcaacagagttacagtacccctctcactttcggcggagggaccaaggtggagatcaagggtggtggtggttctggcggcggcggctccggcgggggtggaagtggtggtggtggttctggtggtggtggttctgaagttcaattgttagagtctggtggcggtcttgttcagcctggtggttctttacgtctttcttgcgctgcttccggattcactttctctcattacgagatgggttgggttcgccaagctcctggtaaaggtttggagtgggtttcttatatctcttcttctggtggctggactgcttatgctgactccgttaaaggtcgcttcactatctctagagacaactctaagaatactctctacttgcagatgaacagcttaagggctgaggacacggccgtgtattactgtgcaaggattggctacgcagatgcttttgatatctggggccaagggaccacggtcaccgtctcaagc

SEQ ID NO: 608 - protein, 250 aa, Artificial
  c868.1  scFv
AIQMTQSPSSLSASVGDRVTITCRASQSISSYLNWYQQKPGKAPKLLIHAASNLQSGVPSRFSGSGSGTDFTLTISSLQPEDFATYYCQQSYSTPLTFGGGTKVEIKGGGGSGGGGSGGGGSGGGGSGGGGSEVQLLESGGGLVQPGGSLRLSCAASGFTFSHYEMGWVRQAPGKGLEWVSYISSSGGWTAYADSVKGRFTISRDNSKNTLYLQMNSLRAEDTAVYYCARIGYADAFDIWGQGTTVTVSS

SEQ ID NO: 609 - DNA, 744 bp, Artificial
  c870.1 scFv cDNA
gaagttcaattgttagagtctggtggcggtcttgttcagcctggtggttctttacgtctttcttgcgctgcttccggattcactttctctggttacattatgtggtgggttcgccaagctcctggtaaaggtttggagtgggtttctgttatctctccttctggtggcgatacttggtatgctgactccgttaaaggtcgcttcactatctctagagacaactctaagaatactctctacttacagatgaacagcttaagggctgaggacacggccgtgtattactgtgccacagcgggagactactggggccagggcaccctggtcaccgtctcaagcggtggtggtggttctggcggcggcggctccggcgggggtggaagtggtggtggtggttctggtggtggtggttctcagagcgaattgactcagccaccctcagcgtctgggacccccgggcagagggtcaccatctcttgttctggaagcagctccaacatcggaaggaatcctgtaaactggtaccagcacctcccaggaacggcccccaaactcctcatctatggtgataatcagcggccctcaggggtccctgaccgattctctggctccaggtctggcacctcagcctccctggccatcagtgggctccagtctgaggatgaggctgattattactgtgcagcatgggatgacagcctgaatggtgtggtattcggcggagggaccaagctgaccgtccta

SEQ ID NO: 610 - protein, 248 aa, Artificial
  c870.1 scFv
EVQLLESGGGLVQPGGSLRLSCAASGFTFSGYIMWWVRQAPGKGLEWVSVISPSGGDTWYADSVKGRFTISRDNSKNTLYLQMNSLRAEDTAVYYCATAGDYWGQGTLVTVSSGGGGSGGGGSGGGGSGGGGSGGGGSQSELTQPPSASGTPGQRVTISCSGSSSNIGRNPVNWYQHLPGTAPKLLIYGDNQRPSGVPDRFSGSRSGTSASLAISGLQSEDEADYYCAAWDDSLNGVVFGGGTKLTVL

SEQ ID NO: 611 - DNA, 759 bp, Artificial
  c1039.1 scFv cDNA
gaagttcaattgttagagtctggtggcggtcttgttcagcctggtggttctttacgtctttcttgcgctgcttccggattcactttctcttggtacgatatggtttgggttcgccaagctcctggtaaaggtttggagtgggtttctgttatctctccttctggtggctggacttcttatgctgactccgttaaaggtcgcttcactatctctagagacaactctaagaatactctctacttgcagatgaacagcttaagggctgaggacacggccgtgtattactgtgcgagagatcatagtggctacgattctgaatactttgactactggggccagggcaccctggtcaccgtctcaagcggtggtggtggttctggcggcggcggctccggcgggggtggaagtggtggtggtggttctggtggtggtggttctaacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccgtacacttttggccaggggaccaagctggagatcaaa

SEQ ID NO: 612 - protein, 253 aa, Artificial
  c1039.1 scFv
EVQLLESGGGLVQPGGSLRLSCAASGFTFSWYDMVWVRQAPGKGLEWVSVISPSGGWTSYADSVKGRFTISRDNSKNTLYLQMNSLRAEDTAVYYCARDHSGYDSEYFDYWGQGTLVTVSSGGGGSGGGGSGGGGSGGGGSGGGGSNIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIK

SEQ ID NO: 613 - DNA, 717 bp, Artificial; identical to SEQ ID NO: 536
  c600.1 VL kappa cDNA

SEQ ID NO: 614 - protein, 239 aa, Artificial; identical to SEQ ID NO: 537
  c600.1 VL kappa

SEQ ID NO: 615 - DNA, 1410 bp, Artificial
  c600.1 whole IgG1 cDNA
atgggatggagctgtatcatcctcttcttggtagcaacagctacaggcgcgcactccgaagttcaattgttagagtctggtggcggtcttgttcagcctggtggttctttacgtctttcttgcgctgcttccggattcactttctctcagtacatgatgctttgggttcgccaagctcctggtaaaggtttggagtgggtttctggtatctctccttctggtggcattactacttatgctgactccgttaaaggtcgcttcactatctctagagacaactctaagaatactctctacttgcagatgaacagcttaagggctgaggacacggccgtgtattactgtgcgagagcttatagcagtggctggtccttaccctttgactactggggccagggaaccctggtcaccgtctcaagcgcctccaccaagggcccatcggtcttcccgctagcaccctcctccaagagcacctctgggggcacagcggccctgggctgcctggtcaaggactacttccccgaaccggtgacggtgtcgtggaactcaggcgccctgaccagcggcgtccacaccttcccggctgtcctacagtcctccggactctactccctcagcagcgtagtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 616 - protein, 470 aa, Artificial
  c600.1 whole IgG1
MGWSCIILFLVATATGAHSEVQLLESGGGLVQPGGSLRLSCAASGFTFSQYMMLWVRQAPGKGLEWVSGISPSGGITTYADSVKGRFTISRDNSKNTLYLQMNSLRAEDTAVYYCARAYSSGWSLPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 617 - DNA, 2310 bp, Artificial
  c941.1-c868.1 bisc 10mer linker Fc5 cDNA
atgggatggagctggatctttctctttcttctgtcaggaactgcaggtgtcctctctgaagttcaattgttagagtctggtggcggtcttgttcagcctggtggttctttacgtctttcttgcgctgcttccggattcactttctctaagtacaagatgcagtgggttcgccaagctcctggtaaaggtttggagtgggtttcttctatctctccttctggtggccttactttttatgctgactccgttaaaggtcgcttcactatctctagagacaactctaagaatactctctacttgcagatgaacagcttaagggctgaggacacggccgtgtattactgtgcgaaagcccgtcggatgagaagcctatgggaggcttttgatatctggggccaagggacaatggtcaccgtctcaagcggtggtggtggttctggcggcggcggctccggcgggggtggaagtggtggtggtggttctggtggtggtggttctgccatccagttgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttaccgggcatctacccgggaatccggggtccctgaccgattcagtggcagcgggtctgggacagatttcactctcaccatcagcagcctgcaggctgaagatgtggcagtttattactgtcagcaatattatagtaccccgtggacgttcggccaagggaccaaggtggaaatcaaagagcccaaatcttcagacaaaactcacacatgcccaccgtgcccagcacctgaagccgagggggcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccatcctccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtggtggcgggggttcgggtggaggaggttctgccatccagatgacccagtctccatcctccctgtctgcatctgtaggagacagagtcaccatcacttgccgggcaagtcagagcattagcagctatttaaattggtatcagcagaaaccagggaaagcccctaaactcctgatccatgctgcatccaatttgcagagtggggtcccatcaaggttcagtggcagtggatctgggacagatttcactctcaccatcagcagtctgcaacctgaagattttgcaacttactactgtcaacagagttacagtacccctctcactttcggcggagggaccaaggtggagatcaagggtggtggtggttctggcggcggcggctccggcgggggtggaagtggtggtggtggttctggtggtggtggttctgaagttcaattgttagagtctggtggcggtcttgttcagcctggtggttctttacgtctttcttgcgctgcttccggattcactttctctcattacgagatgggttgggttcgccaagctcctggtaaaggtttggagtgggtttcttatatctcttcttctggtggctggactgcttatgctgactccgttaaaggtcgcttcactatctctagagacaactctaagaatactctctacttgcagatgaacagcttaagggctgaggacacggccgtgtattactgtgcaaggattggctacgcagatgcttttgatatctggggccaagggaccacggtcaccgtctcaagc

SEQ ID NO: 618 - protein, 770 aa, Artificial
  c941.1-c868.1 bisc 10mer linker Fc5
MGWSWIFLFLLSGTAGVLSEVQLLESGGGLVQPGGSLRLSCAASGFTFSKYKMQWVRQAPGKGLEWVSSISPSGGLTFYADSVKGRFTISRDNSKNTLYLQMNSLRAEDTAVYYCAKARRMRSLWEAFDIWGQGTMVTVSSGGGGSGGGGSGGGGSGGGGSGGGGSAIQLTQSPDSLAVSLGERATINCKSSQSVLYSSNNKNYLAWYQQKPGQPPKLLIYRASTRESGVPDRFSGSGSGTDFTLTISSLQAEDVAVYYCQQYYSTPWTFGQGTKVEIKEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSAIQMTQSPSSLSASVGDRVTITCRASQSISSYLNWYQQKPGKAPKLLIHAASNLQSGVPSRFSGSGSGTDFTLTISSLQPEDFATYYCQQSYSTPLTFGGGTKVEIKGGGGSGGGGSGGGGSGGGGSGGGGSEVQLLESGGGLVQPGGSLRLSCAASGFTFSHYEMGWVRQAPGKGLEWVSYISSSGGWTAYADSVKGRFTISRDNSKNTLYLQMNSLRAEDTAVYYCARIGYADAFDIWGQGTTVTVSS

SEQ ID NO: 619 - DNA, 2304 bp, Artificial
  c941.1-c870.1 bisc 10mer linker Fc5 cDNA
atgggatggagctggatctttctctttcttctgtcaggaactgcaggtgtcctctctgaagttcaattgttagagtctggtggcggtcttgttcagcctggtggttctttacgtctttcttgcgctgcttccggattcactttctctaagtacaagatgcagtgggttcgccaagctcctggtaaaggtttggagtgggtttcttctatctctccttctggtggccttactttttatgctgactccgttaaaggtcgcttcactatctctagagacaactctaagaatactctctacttgcagatgaacagcttaagggctgaggacacggccgtgtattactgtgcgaaagcccgtcggatgagaagcctatgggaggcttttgatatctggggccaagggacaatggtcaccgtctcaagcggtggtggtggttctggcggcggcggctccggcgggggtggaagtggtggtggtggttctggtggtggtggttctgccatccagttgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttaccgggcatctacccgggaatccggggtccctgaccgattcagtggcagcgggtctgggacagatttcactctcaccatcagcagcctgcaggctgaagatgtggcagtttattactgtcagcaatattatagtaccccgtggacgttcggccaagggaccaaggtggaaatcaaagagcccaaatcttcagacaaaactcacacatgcccaccgtgcccagcacctgaagccgagggggcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccatcctccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtggtggcgggggttcgggtggaggaggttctgaagttcaattgttagagtctggtggcggtcttgttcagcctggtggttctttacgtctttcttgcgctgcttccggattcactttctctggttacattatgtggtgggttcgccaagctcctggtaaaggtttggagtgggtttctgttatctctccttctggtggcgatacttggtatgctgactccgttaaaggtcgcttcactatctctagagacaactctaagaatactctctacttacagatgaacagcttaagggctgaggacacggccgtgtattactgtgccacagcgggagactactggggccagggcaccctggtcaccgtctcaagcggtggtggtggttctggcggcggcggctccggcgggggtggaagtggtggtggtggttctggtggtggtggttctcagagcgaattgactcagccaccctcagcgtctgggacccccgggcagagggtcaccatctcttgttctggaagcagctccaacatcggaaggaatcctgtaaactggtaccagcacctcccaggaacggcccccaaactcctcatctatggtgataatcagcggccctcaggggtccctgaccgattctctggctccaggtctggcacctcagcctccctggccatcagtgggctccagtctgaggatgaggctgattattactgtgcagcatgggatgacagcctgaatggtgtggtattcggcggagggaccaagctgaccgtccta

SEQ ID NO: 620 - protein, 768 aa, Artificial
  c941.1-c870.1 bisc 10mer linker Fc5
MGWSWIFLFLLSGTAGVLSEVQLLESGGGLVQPGGSLRLSCAASGFTFSKYKMQWVRQAPGKGLEWVSSISPSGGLTFYADSVKGRFTISRDNSKNTLYLQMNSLRAEDTAVYYCAKARRMRSLWEAFDIWGQGTMVTVSSGGGGSGGGGSGGGGSGGGGSGGGGSAIQLTQSPDSLAVSLGERATINCKSSQSVLYSSNNKNYLAWYQQKPGQPPKLLIYRASTRESGVPDRFSGSGSGTDFTLTISSLQAEDVAVYYCQQYYSTPWTFGQGTKVEIKEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSEVQLLESGGGLVQPGGSLRLSCAASGFTFSGYIMWWVRQAPGKGLEWVSVISPSGGDTWYADSVKGRFTISRDNSKNTLYLQMNSLRAEDTAVYYCATAGDYWGQGTLVTVSSGGGGSGGGGSGGGGSGGGGSGGGGSQSELTQPPSASGTPGQRVTISCSGSSSNIGRNPVNWYQHLPGTAPKLLIYGDNQRPSGVPDRFSGSRSGTSASLAISGLQSEDEADYYCAAWDDSLNGVVFGGGTKLTVL

SEQ ID NO: 621 - DNA, 2319 bp, Artificial
  c941.1-c1039.1 bisc 10mer linker Fc5 cDNA
atgggatggagctggatctttctctttcttctgtcaggaactgcaggtgtcctctctgaagttcaattgttagagtctggtggcggtcttgttcagcctggtggttctttacgtctttcttgcgctgcttccggattcactttctctaagtacaagatgcagtgggttcgccaagctcctggtaaaggtttggagtgggtttcttctatctctccttctggtggccttactttttatgctgactccgttaaaggtcgcttcactatctctagagacaactctaagaatactctctacttgcagatgaacagcttaagggctgaggacacggccgtgtattactgtgcgaaagcccgtcggatgagaagcctatgggaggcttttgatatctggggccaagggacaatggtcaccgtctcaagcggtggtggtggttctggcggcggcggctccggcgggggtggaagtggtggtggtggttctggtggtggtggttctgccatccagttgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttaccgggcatctacccgggaatccggggtccctgaccgattcagtggcagcgggtctgggacagatttcactctcaccatcagcagcctgcaggctgaagatgtggcagtttattactgtcagcaatattatagtaccccgtggacgttcggccaagggaccaaggtggaaatcaaagagcccaaatcttcagacaaaactcacacatgcccaccgtgcccagcacctgaagccgagggggcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccatcctccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtggtggcgggggttcgggtggaggaggttctgaagttcaattgttagagtctggtggcggtcttgttcagcctggtggttctttacgtctttcttgcgctgcttccggattcactttctcttggtacgatatggtttgggttcgccaagctcctggtaaaggtttggagtgggtttctgttatctctccttctggtggctggacttcttatgctgactccgttaaaggtcgcttcactatctctagagacaactctaagaatactctctacttgcagatgaacagcttaagggctgaggacacggccgtgtattactgtgcgagagatcatagtggctacgattctgaatactttgactactggggccagggcaccctggtcaccgtctcaagcggtggtggtggttctggcggcggcggctccggcgggggtggaagtggtggtggtggttctggtggtggtggttctaacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccgtacacttttggccaggggaccaagctggagatcaaa

SEQ ID NO: 622 - protein, 773 aa, Artificial
  c941.1-c1039.1 bisc 10mer linker Fc5
MGWSWIFLFLLSGTAGVLSEVQLLESGGGLVQPGGSLRLSCAASGFTFSKYKMQWVRQAPGKGLEWVSSISPSGGLTFYADSVKGRFTISRDNSKNTLYLQMNSLRAEDTAVYYCAKARRMRSLWEAFDIWGQGTMVTVSSGGGGSGGGGSGGGGSGGGGSGGGGSAIQLTQSPDSLAVSLGERATINCKSSQSVLYSSNNKNYLAWYQQKPGQPPKLLIYRASTRESGVPDRFSGSGSGTDFTLTISSLQAEDVAVYYCQQYYSTPWTFGQGTKVEIKEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSEVQLLESGGGLVQPGGSLRLSCAASGFTFSWYDMVWVRQAPGKGLEWVSVISPSGGWTSYADSVKGRFTISRDNSKNTLYLQMNSLRAEDTAVYYCARDHSGYDSEYFDYWGQGTLVTVSSGGGGSGGGGSGGGGSGGGGSGGGGSNIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIK

SEQ ID NO: 623 - DNA, 2310 bp, Artificial
  c1035.1-c868.1 bisc 10mer linker Fc5 cDNA
atgggatggagctggatctttctctttcttctgtcaggaactgcaggtgtcctctctgaagttcaattgttagagtctggtggcggtcttgttcagcctggtggttctttacgtctttcttgcgctgcttccggattcactttctctatgtactttatgtcttgggttcgccaagctcctggtaaaggtttggagtgggtttctggtatctctccttctggtggcatgactttttatgctgactccgttaaaggtcgcttcactatctctagagacaactctaagaatactctctacttgcagatgaacagcttaagggctgaggacacggccgtgtattactgtgcaaaagatggcatccccctatctatagctgcgccgattgactactggggccaggggaccctggtcaccgtctcaagcggtggtggtggttctggcggcggcggctccggcgggggtggaagtggtggtggtggttctggtggtggtggttctgccatccagatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcccatcaccttcggccaagggacacgactggagattaaagagcccaaatcttcagacaaaactcacacatgcccaccgtgcccagcacctgaagccgagggggcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccatcctccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtggtggcgggggttcgggtggaggaggttctgccatccagatgacccagtctccatcctccctgtctgcatctgtaggagacagagtcaccatcacttgccgggcaagtcagagcattagcagctatttaaattggtatcagcagaaaccagggaaagcccctaaactcctgatccatgctgcatccaatttgcagagtggggtcccatcaaggttcagtggcagtggatctgggacagatttcactctcaccatcagcagtctgcaacctgaagattttgcaacttactactgtcaacagagttacagtacccctctcactttcggcggagggaccaaggtggagatcaagggtggtggtggttctggcggcggcggctccggcgggggtggaagtggtggtggtggttctggtggtggtggttctgaagttcaattgttagagtctggtggcggtcttgttcagcctggtggttctttacgtctttcttgcgctgcttccggattcactttctctcattacgagatgggttgggttcgccaagctcctggtaaaggtttggagtgggtttcttatatctcttcttctggtggctggactgcttatgctgactccgttaaaggtcgcttcactatctctagagacaactctaagaatactctctacttgcagatgaacagcttaagggctgaggacacggccgtgtattactgtgcaaggattggctacgcagatgcttttgatatctggggccaagggaccacggtcaccgtctcaagc

SEQ ID NO: 624 - protein, 770 aa, Artificial
  c1035.1-c868.1 bisc 10mer linker Fc5
MGWSWIFLFLLSGTAGVLSEVQLLESGGGLVQPGGSLRLSCAASGFTFSMYFMSWVRQAPGKGLEWVSGISPSGGMTFYADSVKGRFTISRDNSKNTLYLQMNSLRAEDTAVYYCAKDGIPLSIAAPIDYWGQGTLVTVSSGGGGSGGGGSGGGGSGGGGSGGGGSAIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPITFGQGTRLEIKEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSAIQMTQSPSSLSASVGDRVTITCRASQSISSYLNWYQQKPGKAPKLLIHAASNLQSGVPSRFSGSGSGTDFTLTISSLQPEDFATYYCQQSYSTPLTFGGGTKVEIKGGGGSGGGGSGGGGSGGGGSGGGGSEVQLLESGGGLVQPGGSLRLSCAASGFTFSHYEMGWVRQAPGKGLEWVSYISSSGGWTAYADSVKGRFTISRDNSKNTLYLQMNSLRAEDTAVYYCARIGYADAFDIWGQGTTVTVSS

SEQ ID NO: 625 - DNA, 2304 bp, Artificial
  c1035.1-c870.1 bisc 10mer linker Fc5 cDNA
atgggatggagctggatctttctctttcttctgtcaggaactgcaggtgtcctctctgaagttcaattgttagagtctggtggcggtcttgttcagcctggtggttctttacgtctttcttgcgctgcttccggattcactttctctatgtactttatgtcttgggttcgccaagctcctggtaaaggtttggagtgggtttctggtatctctccttctggtggcatgactttttatgctgactccgttaaaggtcgcttcactatctctagagacaactctaagaatactctctacttgcagatgaacagcttaagggctgaggacacggccgtgtattactgtgcaaaagatggcatccccctatctatagctgcgccgattgactactggggccaggggaccctggtcaccgtctcaagcggtggtggtggttctggcggcggcggctccggcgggggtggaagtggtggtggtggttctggtggtggtggttctgccatccagatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcccatcaccttcggccaagggacacgactggagattaaagagcccaaatcttcagacaaaactcacacatgcccaccgtgcccagcacctgaagccgagggggcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccatcctccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtggtggcgggggttcgggtggaggaggttctgaagttcaattgttagagtctggtggcggtcttgttcagcctggtggttctttacgtctttcttgcgctgcttccggattcactttctctggttacattatgtggtgggttcgccaagctcctggtaaaggtttggagtgggtttctgttatctctccttctggtggcgatacttggtatgctgactccgttaaaggtcgcttcactatctctagagacaactctaagaatactctctacttacagatgaacagcttaagggctgaggacacggccgtgtattactgtgccacagcgggagactactggggccagggcaccctggtcaccgtctcaagcggtggtggtggttctggcggcggcggctccggcgggggtggaagtggtggtggtggttctggtggtggtggttctcagagcgaattgactcagccaccctcagcgtctgggacccccgggcagagggtcaccatctcttgttctggaagcagctccaacatcggaaggaatcctgtaaactggtaccagcacctcccaggaacggcccccaaactcctcatctatggtgataatcagcggccctcaggggtccctgaccgattctctggctccaggtctggcacctcagcctccctggccatcagtgggctccagtctgaggatgaggctgattattactgtgcagcatgggatgacagcctgaatggtgtggtattcggcggagggaccaagctgaccgtccta

SEQ ID NO: 626 - protein, 768 aa, Artificial [sequence omitted]

SEQ ID NO: 627 - DNA, 2319 bp, Artificial
  c1035.1-c1039.1 bisc 10mer linker Fc5 cDNA
atgggatggagctggatctttctctttcttctgtcaggaactgcaggtgtcctctctgaagttcaattgttagagtctggtggcggtcttgttcagcctggtggttctttacgtctttcttgcgctgcttccggattcactttctctatgtactttatgtcttgggttcgccaagctcctggtaaaggtttggagtgggtttctggtatctctccttctggtggcatgactttttatgctgactccgttaaaggtcgcttcactatctctagagacaactctaagaatactctctacttgcagatgaacagcttaagggctgaggacacggccgtgtattactgtgcaaaagatggcatccccctatctatagctgcgccgattgactactggggccaggggaccctggtcaccgtctcaagcggtggtggtggttctggcggcggcggctccggcgggggtggaagtggtggtggtggttctggtggtggtggttctgccatccagatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcccatcaccttcggccaagggacacgactggagattaaagagcccaaatcttcagacaaaactcacacatgcccaccgtgcccagcacctgaagccgagggggcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccatcctccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtggtggcgggggttcgggtggaggaggttctgaagttcaattgttagagtctggtggcggtcttgttcagcctggtggttctttacgtctttcttgcgctgcttccggattcactttctcttggtacgatatggtttgggttcgccaagctcctggtaaaggtttggagtgggtttctgttatctctccttctggtggctggacttcttatgctgactccgttaaaggtcgcttcactatctctagagacaactctaagaatactctctacttgcagatgaacagcttaagggctgaggacacggccgtgtattactgtgcgagagatcatagtggctacgattctgaatactttgactactggggccagggcaccctggtcaccgtctcaagcggtggtggtggttctggcggcggcggctccggcgggggtggaagtggtggtggtggttctggtggtggtggttctaacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccgtacacttttggccaggggaccaagctggagatcaaa

SEQ ID NO: 628 - protein, 773 aa, Artificial
  c1035.1-c1039.1 bisc 10mer linker Fc5
MGWSWIFLFLLSGTAGVLSEVQLLESGGGLVQPGGSLRLSCAASGFTFSMYFMSWVRQAPGKGLEWVSGISPSGGMTFYADSVKGRFTISRDNSKNTLYLQMNSLRAEDTAVYYCAKDGIPLSIAAPIDYWGQGTLVTVSSGGGGSGGGGSGGGGSGGGGSGGGGSAIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPITFGQGTRLEIKEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSEVQLLESGGGLVQPGGSLRLSCAASGFTFSWYDMVWVRQAPGKGLEWVSVISPSGGWTSYADSVKGRFTISRDNSKNTLYLQMNSLRAEDTAVYYCARDHSGYDSEYFDYWGQGTLVTVSSGGGGSGGGGSGGGGSGGGGSGGGGSNIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIK

SEQ ID NO: 629 - DNA, 2187 bp, Artificial
  c597.1-c868.1 biAb 10mer linker IgG1.1 cDNA
atgggatggagctgtatcatcctcttcttggtagcaacagctacaggcgcgcactccgaagttcaattgttagagtctggtggcggtcttgttcagcctggtggttctttacgtctttcttgcgctgcttccggattcactttctctaagtacaagatgctttgggttcgccaagctcctggtaaaggtttggagtgggtttcttctatctatccttctggtggcgttactttttatgctgactccgttaaaggtcgcttcactatctctagagacaactctaagaatactctctacttgcagatgaacagcttaagggctgaggacacggccgtgtattactgtgcaagagatggggagatgatttcgggtagtttctttgactcctggggccagggaaccctggtcaccgtctcaagcgcctccaccaagggcccatcggtcttcccgctagcaccctcctccaagagcacctctgggggcacagcagccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagccgagggggcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccatcctccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtggtggcgggggttcgggtggaggaggttctgccatccagatgacccagtctccatcctccctgtctgcatctgtaggagacagagtcaccatcacttgccgggcaagtcagagcattagcagctatttaaattggtatcagcagaaaccagggaaagcccctaaactcctgatccatgctgcatccaatttgcagagtggggtcccatcaaggttcagtggcagtggatctgggacagatttcactctcaccatcagcagtctgcaacctgaagattttgcaacttactactgtcaacagagttacagtacccctctcactttcggcggagggaccaaggtggagatcaagggtggtggtggttctggcggcggcggctccggcgggggtggaagtggtggtggtggttctggtggtggtggttctgaagttcaattgttagagtctggtggcggtcttgttcagcctggtggttctttacgtctttcttgcgctgcttccggattcactttctctcattacgagatgggttgggttcgccaagctcctggtaaaggtttggagtgggtttcttatatctcttcttctggtggctggactgcttatgctgactccgttaaaggtcgcttcactatctctagagacaactctaagaatactctctacttgcagatgaacagcttaagggctgaggacacggccgtgtattactgtgcaaggattggctacgcagatgcttttgatatctggggccaagggaccacggtcaccgtctcaagc

SEQ ID NO: 630 - protein, 729 aa, Artificial
  c597.1-c868.1 biAb 10mer linker IgG1.1
MGWSCIILFLVATATGAHSEVQLLESGGGLVQPGGSLRLSCAASGFTFSKYKMLWVRQAPGKGLEWVSSIYPSGGVTFYADSVKGRFTISRDNSKNTLYLQMNSLRAEDTAVYYCARDGEMISGSFFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSAIQMTQSPSSLSASVGDRVTITCRASQSISSYLNWYQQKPGKAPKLLIHAASNLQSGVPSRFSGSGSGTDFTLTISSLQPEDFATYYCQQSYSTPLTFGGGTKVEIKGGGGSGGGGSGGGGSGGGGSGGGGSEVQLLESGGGLVQPGGSLRLSCAASGFTFSHYEMGWVRQAPGKGLEWVSYISSSGGWTAYADSVKGRFTISRDNSKNTLYLQMNSLRAEDTAVYYCARIGYADAFDIWGQGTTVTVSS

SEQ ID NO: 631 - DNA, 2181 bp, Artificial
  c597.1-c870.1 biAb 10mer linker IgG1.1 cDNA
atgggatggagctgtatcatcctcttcttggtagcaacagctacaggcgcgcactccgaagttcaattgttagagtctggtggcggtcttgttcagcctggtggttctttacgtctttcttgcgctgcttccggattcactttctctaagtacaagatgctttgggttcgccaagctcctggtaaaggtttggagtgggtttcttctatctatccttctggtggcgttactttttatgctgactccgttaaaggtcgcttcactatctctagagacaactctaagaatactctctacttgcagatgaacagcttaagggctgaggacacggccgtgtattactgtgcaagagatggggagatgatttcgggtagtttctttgactcctggggccagggaaccctggtcaccgtctcaagcgcctccaccaagggcccatcggtcttcccgctagcaccctcctccaagagcacctctgggggcacagcagccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagccgagggggcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccatcctccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtggtggcgggggttcgggtggaggaggttctgaagttcaattgttagagtctggtggcggtcttgttcagcctggtggttctttacgtctttcttgcgctgcttccggattcactttctctggttacattatgtggtgggttcgccaagctcctggtaaaggtttggagtgggtttctgttatctctccttctggtggcgatacttggtatgctgactccgttaaaggtcgcttcactatctctagagacaactctaagaatactctctacttacagatgaacagcttaagggctgaggacacggccgtgtattactgtgccacagcgggagactactggggccagggcaccctggtcaccgtctcaagcggtggtggtggttctggcggcggcggctccggcgggggtggaagtggtggtggtggttctggtggtggtggttctcagagcgaattgactcagccaccctcagcgtctgggacccccgggcagagggtcaccatctcttgttctggaagcagctccaacatcggaaggaatcctgtaaactggtaccagcacctcccaggaacggcccccaaactcctcatctatggtgataatcagcggccctcaggggtccctgaccgattctctggctccaggtctggcacctcagcctccctggccatcagtgggctccagtctgaggatgaggctgattattactgtgcagcatgggatgacagcctgaatggtgtggtattcggcggagggaccaagctgaccgtccta

SEQ ID NO: 632 - protein, 727 aa, Artificial
  c597.1-c870.1 biAb 10mer linker IgG1.1
MGWSCIILFLVATATGAHSEVQLLESGGGLVQPGGSLRLSCAASGFTFSKYKMLWVRQAPGKGLEWVSSIYPSGGVTFYADSVKGRFTISRDNSKNTLYLQMNSLRAEDTAVYYCARDGEMISGSFFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSEVQLLESGGGLVQPGGSLRLSCAASGFTFSGYIMWWVRQAPGKGLEWVSVISPSGGDTWYADSVKGRFTISRDNSKNTLYLQMNSLRAEDTAVYYCATAGDYWGQGTLVTVSSGGGGSGGGGSGGGGSGGGGSGGGGSQSELTQPPSASGTPGQRVTISCSGSSSNIGRNPVNWYQHLPGTAPKLLIYGDNQRPSGVPDRFSGSRSGTSASLAISGLQSEDEADYYCAAWDDSLNGVVFGGGTKLTVL

SEQ ID NO: 633 - DNA, 2196 bp, Artificial
  c597.1-c1039.1 biAb 10mer linker IgG1.1 cDNA
atgggatggagctgtatcatcctcttcttggtagcaacagctacaggcgcgcactccgaagttcaattgttagagtctggtggcggtcttgttcagcctggtggttctttacgtctttcttgcgctgcttccggattcactttctctaagtacaagatgctttgggttcgccaagctcctggtaaaggtttggagtgggtttcttctatctatccttctggtggcgttactttttatgctgactccgttaaaggtcgcttcactatctctagagacaactctaagaatactctctacttgcagatgaacagcttaagggctgaggacacggccgtgtattactgtgcaagagatggggagatgatttcgggtagtttctttgactcctggggccagggaaccctggtcaccgtctcaagcgcctccaccaagggcccatcggtcttcccgctagcaccctcctccaagagcacctctgggggcacagcagccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagccgagggggcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccatcctccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtggtggcgggggttcgggtggaggaggttctgaagttcaattgttagagtctggtggcggtcttgttcagcctggtggttctttacgtctttcttgcgctgcttccggattcactttctcttggtacgatatggtttgggttcgccaagctcctggtaaaggtttggagtgggtttctgttatctctccttctggtggctggacttcttatgctgactccgttaaaggtcgcttcactatctctagagacaactctaagaatactctctacttgcagatgaacagcttaagggctgaggacacggccgtgtattactgtgcgagagatcatagtggctacgattctgaatactttgactactggggccagggcaccctggtcaccgtctcaagcggtggtggtggttctggcggcggcggctccggcgggggtggaagtggtggtggtggttctggtggtggtggttctaacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccgtacacttttggccaggggaccaagctggagatcaaa

SEQ ID NO: 634 - protein, 732 aa, Artificial
  c597.1-c1039.1 biAb 10mer linker IgG1.1
MGWSCIILFLVATATGAHSEVQLLESGGGLVQPGGSLRLSCAASGFTFSKYKMLWVRQAPGKGLEWVSSIYPSGGVTFYADSVKGRFTISRDNSKNTLYLQMNSLRAEDTAVYYCARDGEMISGSFFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSEVQLLESGGGLVQPGGSLRLSCAASGFTFSWYDMVWVRQAPGKGLEWVSVISPSGGWTSYADSVKGRFTISRDNSKNTLYLQMNSLRAEDTAVYYCARDHSGYDSEYFDYWGQGTLVTVSSGGGGSGGGGSGGGGSGGGGSGGGGSNIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIK

SEQ ID NO: 635 - DNA, 2187 bp, Artificial
  c600.1-c868.1 biAb 10mer linker IgG1.1 cDNA
atgggatggagctgtatcatcctcttcttggtagcaacagctacaggcgcgcactccgaagttcaattgttagagtctggtggcggtcttgttcagcctggtggttctttacgtctttcttgcgctgcttccggattcactttctctcagtacatgatgctttgggttcgccaagctcctggtaaaggtttggagtgggtttctggtatctctccttctggtggcattactacttatgctgactccgttaaaggtcgcttcactatctctagagacaactctaagaatactctctacttgcagatgaacagcttaagggctgaggacacggccgtgtattactgtgcgagagcttatagcagtggctggtccttaccctttgactactggggccagggaaccctggtcaccgtctcaagcgcctccaccaagggcccatcggtcttcccgctagcaccctcctccaagagcacctctgggggcacagcagccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagccgagggggcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccatcctccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtggtggcgggggttcgggtggaggaggttctgccatccagatgacccagtctccatcctccctgtctgcatctgtaggagacagagtcaccatcacttgccgggcaagtcagagcattagcagctatttaaattggtatcagcagaaaccagggaaagcccctaaactcctgatccatgctgcatccaatttgcagagtggggtcccatcaaggttcagtggcagtggatctgggacagatttcactctcaccatcagcagtctgcaacctgaagattttgcaacttactactgtcaacagagttacagtacccctctcactttcggcggagggaccaaggtggagatcaagggtggtggtggttctggcggcggcggctccggcgggggtggaagtggtggtggtggttctggtggtggtggttctgaagttcaattgttagagtctggtggcggtcttgttcagcctggtggttctttacgtctttcttgcgctgcttccggattcactttctctcattacgagatgggttgggttcgccaagctcctggtaaaggtttggagtgggtttcttatatctcttcttctggtggctggactgcttatgctgactccgttaaaggtcgcttcactatctctagagacaactctaagaatactctctacttgcagatgaacagcttaagggctgaggacacggccgtgtattactgtgcaaggattggctacgcagatgcttttgatatctggggccaagggaccacggtcaccgtctcaagc

SEQ ID NO: 636 - protein, 729 aa, Artificial
  c600.1-c868.1 biAb 10mer linker IgG1.1
MGWSCIILFLVATATGAHSEVQLLESGGGLVQPGGSLRLSCAASGFTFSQYMMLWVRQAPGKGLEWVSGISPSGGITTYADSVKGRFTISRDNSKNTLYLQMNSLRAEDTAVYYCARAYSSGWSLPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSAIQMTQSPSSLSASVGDRVTITCRASQSISSYLNWYQQKPGKAPKLLIHAASNLQSGVPSRFSGSGSGTDFTLTISSLQPEDFATYYCQQSYSTPLTFGGGTKVEIKGGGGSGGGGSGGGGSGGGGSGGGGSEVQLLESGGGLVQPGGSLRLSCAASGFTFSHYEMGWVRQAPGKGLEWVSYISSSGGWTAYADSVKGRFTISRDNSKNTLYLQMNSLRAEDTAVYYCARIGYADAFDIWGQGTTVTVSS

SEQ ID NO: 637 - DNA, 2181 bp, Artificial
  c600.1-c870.1 biAb 10mer linker IgG1.1 cDNA
atgggatggagctgtatcatcctcttcttggtagcaacagctacaggcgcgcactccgaagttcaattgttagagtctggtggcggtcttgttcagcctggtggttctttacgtctttcttgcgctgcttccggattcactttctctcagtacatgatgctttgggttcgccaagctcctggtaaaggtttggagtgggtttctggtatctctccttctggtggcattactacttatgctgactccgttaaaggtcgcttcactatctctagagacaactctaagaatactctctacttgcagatgaacagcttaagggctgaggacacggccgtgtattactgtgcgagagcttatagcagtggctggtccttaccctttgactactggggccagggaaccctggtcaccgtctcaagcgcctccaccaagggcccatcggtcttcccgctagcaccctcctccaagagcacctctgggggcacagcagccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagccgagggggcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccatcctccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtggtggcgggggttcgggtggaggaggttctgaagttcaattgttagagtctggtggcggtcttgttcagcctggtggttctttacgtctttcttgcgctgcttccggattcactttctctggttacattatgtggtgggttcgccaagctcctggtaaaggtttggagtgggtttctgttatctctccttctggtggcgatacttggtatgctgactccgttaaaggtcgcttcactatctctagagacaactctaagaatactctctacttacagatgaacagcttaagggctgaggacacggccgtgtattactgtgccacagcgggagactactggggccagggcaccctggtcaccgtctcaagcggtggtggtggttctggcggcggcggctccggcgggggtggaagtggtggtggtggttctggtggtggtggttctcagagcgaattgactcagccaccctcagcgtctgggacccccgggcagagggtcaccatctcttgttctggaagcagctccaacatcggaaggaatcctgtaaactggtaccagcacctcccaggaacggcccccaaactcctcatctatggtgataatcagcggccctcaggggtccctgaccgattctctggctccaggtctggcacctcagcctccctggccatcagtgggctccagtctgaggatgaggctgattattactgtgcagcatgggatgacagcctgaatggtgtggtattcggcggagggaccaagctgaccgtccta

SEQ ID NO: 638 - protein, 727 aa, Artificial
  c600.1-c870.1 biAb 10mer linker IgG1.1
MGWSCIILFLVATATGAHSEVQLLESGGGLVQPGGSLRLSCAASGFTFSQYMMLWVRQAPGKGLEWVSGISPSGGITTYADSVKGRFTISRDNSKNTLYLQMNSLRAEDTAVYYCARAYSSGWSLPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSEVQLLESGGGLVQPGGSLRLSCAASGFTFSGYIMWWVRQAPGKGLEWVSVISPSGGDTWYADSVKGRFTISRDNSKNTLYLQMNSLRAEDTAVYYCATAGDYWGQGTLVTVSSGGGGSGGGGSGGGGSGGGGSGGGGSQSELTQPPSASGTPGQRVTISCSGSSSNIGRNPVNWYQHLPGTAPKLLIYGDNQRPSGVPDRFSGSRSGTSASLAISGLQSEDEADYYCAAWDDSLNGVVFGGGTKLTVL

SEQ ID NO: 639 - DNA, 2196 bp, Artificial
  c600.1-c1039.1 biAb 10mer linker IgG1.1 cDNA
atgggatggagctgtatcatcctcttcttggtagcaacagctacaggcgcgcactccgaagttcaattgttagagtctggtggcggtcttgttcagcctggtggttctttacgtctttcttgcgctgcttccggattcactttctctcagtacatgatgctttgggttcgccaagctcctggtaaaggtttggagtgggtttctggtatctctccttctggtggcattactacttatgctgactccgttaaaggtcgcttcactatctctagagacaactctaagaatactctctacttgcagatgaacagcttaagggctgaggacacggccgtgtattactgtgcgagagcttatagcagtggctggtccttaccctttgactactggggccagggaaccctggtcaccgtctcaagcgcctccaccaagggcccatcggtcttcccgctagcaccctcctccaagagcacctctgggggcacagcagccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagccgagggggcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccatcctccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtggtggcgggggttcgggtggaggaggttctgaagttcaattgttagagtctggtggcggtcttgttcagcctggtggttctttacgtctttcttgcgctgcttccggattcactttctcttggtacgatatggtttgggttcgccaagctcctggtaaaggtttggagtgggtttctgttatctctccttctggtggctggacttcttatgctgactccgttaaaggtcgcttcactatctctagagacaactctaagaatactctctacttgcagatgaacagcttaagggctgaggacacggccgtgtattactgtgcgagagatcatagtggctacgattctgaatactttgactactggggccagggcaccctggtcaccgtctcaagcggtggtggtggttctggcggcggcggctccggcgggggtggaagtggtggtggtggttctggtggtggtggttctaacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccgtacacttttggccaggggaccaagctggagatcaaa

SEQ ID NO: 640 - protein, 732 aa, Artificial
  c600.1-c1039.1 biAb 10mer linker IgG1.1
MGWSCIILFLVATATGAHSEVQLLESGGGLVQPGGSLRLSCAASGFTFSQYMMLWVRQAPGKGLEWVSGISPSGGITTYADSVKGRFTISRDNSKNTLYLQMNSLRAEDTAVYYCARAYSSGWSLPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSEVQLLESGGGLVQPGGSLRLSCAASGFTFSWYDMVWVRQAPGKGLEWVSVISPSGGWTSYADSVKGRFTISRDNSKNTLYLQMNSLRAEDTAVYYCARDHSGYDSEYFDYWGQGTLVTVSSGGGGSGGGGSGGGGSGGGGSGGGGSNIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIK

SEQ ID NO: 641 - DNA, 990 bp, Artificial
  IgG1.1 cDNA
gcctccaccaagggcccatcggtcttcccgctagcaccctcctccaagagcacctctgggggcacagcagccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagccgagggggcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccatcctccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 642 - protein, 330 aa, Artificial
  IgG1.1
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 643 - DNA, 696 bp, Artificial
  Fc5 cDNA
gagcccaaatcttcagacaaaactcacacatgcccaccgtgcccagcacctgaagccgagggggcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccatcctccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 644 - protein, 409 aa, Artificial [sequence omitted]

SEQ ID NO: 645 - DNA, 35 bp, Artificial
  Oligonucleotide primer zc60375
atatatgtgcactctgacatccagatgacccagtc

SEQ ID NO: 646 - DNA, 23 bp, Artificial
  Oligonucleotide primer zc60376
ggagggtgctagcgggaagaccg

SEQ ID NO: 647 - DNA, 7479 bp, Artificial
  pZMP31
cagtcacgacgttgtaaaacgacggccagtgagtgacgttgcattagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttgcaatgaaagaccccacctgtaggtttggcaagctagcttaagtaacgccatttgcaaggcatggaaaaatacataactgagaatagagaagttcagatcaaggtcaggaacagagaaacaggagaatatgggccaaacaggatatctgtggtaagcagttcctgccccgctcagggccaagaacagttggaacaggagaatatgggccaaacaggatatctgtggtaagcagttcctgccccgctcagggccaagaacagatggtccccagatcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccggggctagcggctcgtggatctcagctacaggtaaggggctcacagtagcaggcttgaggtctggccatatacatcggtgacattgacatccactttgcctttctctccacaggtgtccagggaattcatataggccggccaccatggatgcaatgaagagagggctctgctgtgtgctgctgctgtgtggcgccgtcttcgtttcgctcagccaggaaatccatgccgagttgagacgcttccgtagatcttaatctagaggcgcgccttaaaacagctctggggttgtacccaccccagaggcccacgtggcggctagtactccggtattgcggtacccttgtacgcctgttttatactcccttcccgtaacttagacgcacaaaaccaagttcaatagaagggggtacaaaccagtaccaccacgaacaagcacttctgtttccccggtgatgtcgtatagactgcttgcgtggttgaaagcggcggatccgttatccgcttatgtacttcgagaagcccagtaccacctcggaatcttcgatgcgttgcgctcagcactcaaccccagagtgtagcttaggctgatgagtctggacatccctcaccggtgacggtggtccaggctgcgttggcggcctacctatggctaacgccatgggacgctagttgtgaacaaggtgtgaagagcctattgagctacataagaatcctccggcccctgaatgcggctaatcccaacctcggagcaggtggtcacaaaccagtgattggcctgtcgtaacgcgcaagtccgtggcggaaccgactactttgggtgtccgtgtttccttttattttattgtggctgcttatggtgacaatcacagattgttatcataaagcgaattggattgcatggttcgaccattgaactgcatcgtcgccgtgtcccaaaatatggggattggcaagaacggagacctaccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaacaggaagatgctttcaagttctctgctcccctcctaaagctatgcatttttataagaccatgggacttttgctggctttagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggagagagactagtagagagtatcgatagagagcgatcgaattaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccaccttttcaattcatcattttttttttattcttttttttgatttcggtttccttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcc

SEQ ID NO: 648 - DNA, 8133 bp, Artificial
  pZMP31-ms 26-10VH-Fc5
cagtcacgacgttgtaaaacgacggccagtgagtgacgttgcattagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttgcaatgaaagaccccacctgtaggtttggcaagctagcttaagtaacgccatttgcaaggcatggaaaaatacataactgagaatagagaagttcagatcaaggtcaggaacagagaaacaggagaatatgggccaaacaggatatctgtggtaagcagttcctgccccgctcagggccaagaacagttggaacaggagaatatgggccaaacaggatatctgtggtaagcagttcctgccccgctcagggccaagaacagatggtccccagatcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccggggctagcggctcgtggatctcagctacaggtaaggggctcacagtagcaggcttgaggtctggccatatacatcggtgacattgacatccactttgcctttctctccacaggtgtccagggaattcatataggccggccaccatgaagttgcctgttaggctgttggtgctgatgttctggattcctgcttccagcagtgcggccgcgagcccaaatcttcagacaaaactcacacatgcccaccgtgcccagcacctgaagccgagggggcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccatcctccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaataaatctagaggcgcgccttaaaacagctctggggttgtacccaccccagaggcccacgtggcggctagtactccggtattgcggtacccttgtacgcctgttttatactcccttcccgtaacttagacgcacaaaaccaagttcaatagaagggggtacaaaccagtaccaccacgaacaagcacttctgtttccccggtgatgtcgtatagactgcttgcgtggttgaaagcggcggatccgttatccgcttatgtacttcgagaagcccagtaccacctcggaatcttcgatgcgttgcgctcagcactcaaccccagagtgtagcttaggctgatgagtctggacatccctcaccggtgacggtggtccaggctgcgttggcggcctacctatggctaacgccatgggacgctagttgtgaacaaggtgtgaagagcctattgagctacataagaatcctccggcccctgaatgcggctaatcccaacctcggagcaggtggtcacaaaccagtgattggcctgtcgtaacgcgcaagtccgtggcggaaccgactactttgggtgtccgtgtttccttttattttattgtggctgcttatggtgacaatcacagattgttatcataaagcgaattggattgcatggttcgaccattgaactgcatcgtcgccgtgtcccaaaatatggggattggcaagaacggagacctaccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaacaggaagatgctttcaagttctctgctcccctcctaaagctatgcatttttataagaccatgggacttttgctggctttagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggagagagactagtagagagtatcgatagagagcgatcgaattaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccaccttttcaattcatcattttttttttattcttttttttgatttcggtttccttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcc

SEQ ID NO: 649 - protein, 20 aa, Artificial
  PDGFRbeta peptide
LVVTLHEKKGDVALPVPYDH

SEQ ID NO: 650 - protein, 20 aa, Artificial
  PDGFRbeta peptide
ITLMCIVIGNEVVNFEWTYP

What is claimed is:

1. An isolated antibody that binds to the extracellular domain of PDGFRβ and neutralizes PDGFRβ activity, said antibody comprising a $V_L$ domain comprising CDRs LCDR1, LCDR2, and LCDR3 and a $V_H$ domain comprising CDRs HCDR1, HCDR2, and HCDR3, wherein
LCDR1 has the amino acid sequence shown in SEQ ID NO:433;
LCDR2 has the amino acid sequence shown in SEQ ID NO:434;
LCDR3 has the amino acid sequence shown in SEQ ID NO:435;
HCDR1 has the amino acid sequence shown in SEQ ID NO:436;
HCDR2 has the amino acid sequence shown in SEQ ID NO:437;
HCDR3 has an amino acid sequence selected from the group consisting of SEQ ID NOs:438-442.

2. The antibody of claim 1, wherein
LCDR1 has the amino acid sequence shown in SEQ ID NO:443;
LCDR3 has the amino acid sequence shown in SEQ ID NO:444;
HCDR1 has the amino acid sequence shown in SEQ ID NO:445.

3. The antibody of claim 2, wherein
HCDR1 has the amino acid sequence shown in SEQ ID NO:446; and
HCDR2 has the amino acid sequence shown in SEQ ID NO:447.

4. The antibody of claim 3, wherein HCDR3 has an amino acid sequence selected from the group consisting of SEQ ID NOs:441 and 442.

5. The antibody of claim 2, wherein
HCDR1, HCDR2, and HCDR3 have the amino acid sequences shown, respectively, in residues 31-35, residues 50-66, and residues 99-110 of SEQ ID NO:8;
HCDR1, HCDR2, and HCDR3 have the amino acid sequences shown, respectively, in residues 31-35, residues 50-66, and residues 99-110 of SEQ ID NO:12;
HCDR1, HCDR2, and HCDR3 have the amino acid sequences shown, respectively, in residues 31-35, residues 50-66, and residues 99-111 of SEQ ID NO:24;
HCDR1, HCDR2, and HCDR3 have the amino acid sequences shown, respectively, in residues 31-35, residues 50-66, and residues 99-110 of SEQ ID NO:36; or
HCDR1, HCDR2, and HCDR3 have the amino acid sequences shown, respectively, in residues 31-35, residues 50-66, and residues 99-111 of SEQ ID NO:48.

6. The antibody of claim 2, wherein
LCDR2 has the amino acid sequence shown in residues 56-62 of SEQ ID NO:6 or 10;
LCDR3 has the amino acid sequence shown in residues 95-103 of SEQ ID NO:6, 10, or 46;
HCDR1 has the amino acid sequence shown in residues 31-35 of SEQ ID NO:8, 12, 24, 36, or 48; and
HCDR2 has the amino acid sequence shown in residues 50-66 of SEQ ID NO:8, 12, 24, 36, or 48.

7. The antibody of claim 6, wherein
(a) LCDR2 and LCDR3 have the amino acid sequences shown, respectively, in residues 56-62 and residues 95-103 of SEQ ID NO:6; and HCDR1, HCDR2, and HCDR3 have the amino acid sequences shown, respectively, in residues 31-35, residues 50-66, and residues 99-110 of SEQ ID NO:8;
(b) LCDR2 and LCDR3 have the amino acid sequences shown, respectively, in residues 56-62 and residues 95-103 of SEQ ID NO:10; and HCDR1, HCDR2, and HCDR3 have the amino acid sequences shown, respectively, in residues 31-35, residues 50-66, and residues 99-110 of SEQ ID NO:12;
(c) LCDR2 and LCDR3 have the amino acid sequences shown, respectively, in residues 56-62 and residues 95-103 of SEQ ID NO:22; and HCDR1, HCDR2, and HCDR3 have the amino acid sequences shown, respectively, in residues 31-35, residues 50-66, and residues 99-111 of SEQ ID NO:24;
(d) LCDR2 and LCDR3 have the amino acid sequences shown, respectively, in residues 56-62 and residues 95-103 of SEQ ID NO:34; and HCDR1, HCDR2, and HCDR3 have the amino acid sequences shown, respectively, in residues 31-35, residues 50-66, and residues 99-110 of SEQ ID NO:36;
(e) LCDR2 and LCDR3 have the amino acid sequences shown, respectively, in residues 56-62 and residues 95-103 of SEQ ID NO:38; and HCDR1, HCDR2, and HCDR3 have the amino acid sequences shown, respectively, in residues 31-35, residues 50-66, and residues 99-110 of SEQ ID NO:40; or
(f) LCDR2 and LCDR3 have the amino acid sequences shown, respectively, in residues 56-62 and residues 95-103 of SEQ ID NO:46; and HCDR1, HCDR2, and HCDR3 have the amino acid sequences shown, respectively, in residues 31-35, residues 50-66, and residues 99-111 of SEQ ID NO:48.

8. The antibody of claim 6, wherein
the $V_L$ and $V_H$ domains comprise the amino acid sequences as shown in SEQ ID NOs:6 and 8, respectively;
the $V_L$ and $V_H$ domains comprise the amino acid sequences as shown in SEQ ID NOs:10 and 12, respectively;
the $V_L$ and $V_H$ domains comprise the amino acid sequences as shown in SEQ ID NOs:22 and 24, respectively;

the V_L and V_H domains comprise the amino acid sequences as shown in SEQ ID NOs:34 and 36, respectively;

the V_L and V_H domains comprise the amino acid sequences as shown in SEQ ID NOs:38 and 40, respectively; or the V_L and V_H domains comprise the amino acid sequences as shown in SEQ ID NOs:46 and 48, respectively.

9. The antibody of claim 6, wherein

LCDR2 and LCDR3 have the amino acid sequences shown, respectively, in residues 56-62 and residues 95-103 of SEQ ID NO:6; and HCDR1, HCDR2, and HCDR3 have the amino acid sequences shown, respectively, in (i) residues 31-35, residues 50-66, and residues 99-110 of SEQ ID NO:8, or (ii) residues 31-35, residues 50-66, and residues 99-110 of SEQ ID NO:12.

10. The antibody of claim 9, wherein the V_L and V_H domains comprise the amino acid sequences as shown in SEQ ID NOs:6 and 8, respectively;

the V_L and V_H domains comprise the amino acid sequences as shown in SEQ ID NOs:10 and 12, respectively; or the V_L and V_H domains comprise the amino acid sequences as shown in SEQ ID NOs:38 and 40, respectively.

11. The antibody of claim 1, wherein the antibody is selected from the group consisting of:

an antibody comprising a V_L domain and a V_H domain comprising the amino acid sequences as shown in SEQ ID NOs:6 and 8, respectively;

an antibody comprising a V_L domain and a V_H domain comprising the amino acid sequences as shown in SEQ ID NOs:10 and 12, respectively;

an antibody comprising a V_L domain and a V_H domain comprising the amino acid sequences as shown in SEQ ID NOs:22 and 24, respectively;

an antibody comprising a V_L domain and a V_H domain comprising the amino acid sequences as shown in SEQ ID NOs:46 and 48, respectively.

12. The antibody of claim 1, wherein the antibody is selected from the group consisting of:

an antibody comprising a V_L domain and a V_H domain comprising the amino acid sequences as shown in SEQ ID NOs:22 and 24, respectively;

an antibody comprising a V_L domain and a V_H domain comprising the amino acid sequences as shown in SEQ ID NOs:46 and 48, respectively.

13. The antibody of claim 1, wherein the antibody is a single chain Fv (scFv).

14. The antibody of claim 1, wherein said antibody is a bispecific antibody that also binds to VEGF-A.

15. A pharmaceutical composition comprising:

the antibody of claim 1 and a pharmaceutically acceptable carrier.

16. An isolated antibody that binds to VEGF-A and neutralizes VEGF-A activity, said antibody comprising a V_L domain comprising CDRs LCDR1, LCDR2, and LCDR3 and a V_H domain comprising CDRs HCDR1, HCDR2, and HCDR3, wherein LCDR1 has the amino acid sequence shown in SEQ ID NO:448;

LCDR2 has the amino acid sequence shown in SEQ ID NO:449;

LCDR3 has the amino acid sequence shown in SEQ ID NO:450;

HCDR1 has the amino acid sequence shown in SEQ ID NO:451;

HCDR2 has the amino acid sequence shown in SEQ ID NO:452;

HCDR3 has an amino acid sequence selected from the group consisting of SEQ ID NOs:453-461.

17. The antibody of claim 16, wherein

LCDR1 has the amino acid sequence shown in SEQ ID NO:462;

LCDR2 has the amino acid sequence shown in SEQ ID NO:464;

LCDR3 has the amino acid sequence shown in SEQ ID NO:466;

HCDR1 has the amino acid sequence shown in SEQ ID NO:468;

HCDR2 has the amino acid sequence shown in SEQ ID NO:470;

HCDR3 has an amino acid sequence selected from the group consisting of SEQ ID NOs :453-459.

18. The antibody of claim 17, wherein

LCDR1 and LCDR2 have the amino acid sequences shown, respectively, in residues 24-34 and residues 50-56 of SEQ ID NO:170;

LCDR1 and LCDR2 have the amino acid sequences shown, respectively, in residues 24-34 and residues 50-56 of SEQ ID NO:242;

LCDR1 and LCDR2 have the amino acid sequences shown, respectively, in residues 24-34 and residues 50-56 of SEQ ID NO:278;

LCDR1 and LCDR2 have the amino acid sequences shown, respectively, in residues 24-34 and residues 50-56 of SEQ ID NO:306;

LCDR1 and LCDR2 have the amino acid sequences shown, respectively, in residues 24-34 and residues 50-56 of SEQ ID NO:322;

LCDR1 and LCDR2 have the amino acid sequences shown, respectively, in residues 24-34 and residues 50-56 of SEQ ID NO:330;

LCDR1 and LCDR2 have the amino acid sequences shown, respectively, in residues 24-34 and residues 50-56 of SEQ ID NO:374;

LCDR1 and LCDR2 have the amino acid sequences shown, respectively, in residues 24-34 and residues 50-56 of SEQ ID NO:394; or LCDR1 and LCDR2 have the amino acid sequences shown, respectively, in residues 24-34 and residues 50-56 of SEQ ID NO:426.

19. The antibody of claim 17 or 18, wherein HCDR1 has the amino acid sequence shown in residues 31-35 of SEQ ID NO:172, 244, 280, 308, or 324.

20. The antibody of claim 19, wherein

HCDR1 has the amino acid sequence shown in residues 31-35 of SEQ ID NO:280 and

HCDR2 has the amino acid sequence shown in residues 50-66 of SEQ ID NO:280, 376, or 428.

21. The antibody of claim 20, wherein

LCDR1 has the amino acid sequence shown in SEQ ID NO:463;

LCDR2 has the amino acid sequence shown in SEQ ID NO:465;

LCDR3 has the amino acid sequence shown in SEQ ID NO:467;

HCDR1 has the amino acid sequence shown in residues 31-35 of SEQ ID NO:280;

HCDR2 has the amino acid sequence shown in residues 50-66 of SEQ ID NO:280.

22. The antibody of claim 21, wherein HCDR3 has an amino acid sequence selected from the group consisting of SEQ ID NOs:453, 458, and 459.

23. The antibody of claim 16, wherein
(a) LCDR1, LCDR2, and LCDR3 have the amino acid sequences shown, respectively, in residues 24-34, residues 50-56, and residues 89-97 of SEQ ID NO:170; and HCDR1, HCDR2, and HCDR3 have the amino acid sequences shown, respectively, in residues 31-35, residues 50-66, and residues 99-102 of SEQ ID NO:172;
(b) LCDR1, LCDR2, and LCDR3 have the amino acid sequences shown, respectively, in residues 24-34, residues 50-56, and residues 89-97 of SEQ ID NO:242; and HCDR1, HCDR2, and HCDR3 have the amino acid sequences shown, respectively, in residues 31-35, residues 50-66, and residues 99-107 of SEQ ID NO:244;
(c) LCDR1, LCDR2, and LCDR3 have the amino acid sequences shown, respectively, in residues 24-34, residues 50-56, and residues 89-97 of SEQ ID NO:278; and HCDR1, HCDR2, and HCDR3 have the amino acid sequences shown, respectively, in residues 31-35, residues 50-66, and residues 99-110 of SEQ ID NO:280;
(d) LCDR1, LCDR2, and LCDR3 have the amino acid sequences shown, respectively, in residues 24-34, residues 50-56, and residues 89-97 of SEQ ID NO:306; and HCDR1, HCDR2, and HCDR3 have the amino acid sequences shown, respectively, in residues 31-35, residues 50-66, and residues 99-110 of SEQ ID NO:308;
(e) LCDR1, LCDR2, and LCDR3 have the amino acid sequences shown, respectively, in residues 24-34, residues 50-56, and residues 89-97 of SEQ ID NO:322; and HCDR1, HCDR2, and HCDR3 have the amino acid sequences shown, respectively, in residues 31-35, residues 50-66, and residues 99-111 of SEQ ID NO:324;
(f) LCDR1, LCDR2, and LCDR3 have the amino acid sequences shown, respectively, in residues 24-34, residues 50-56, and residues 89-97 of SEQ ID NO:330; and HCDR1, HCDR2, and HCDR3 have the amino acid sequences shown, respectively, in residues 31-35, residues 50-66, and residues 99-102 of SEQ ID NO:332;
(g) LCDR1, LCDR2, and LCDR3 have the amino acid sequences shown, respectively, in residues 24-34, residues 50-56, and residues 89-97 of SEQ ID NO:374; and HCDR1, HCDR2, and HCDR3 have the amino acid sequences shown, respectively, in residues 31-35, residues 50-66, and residues 99-108 of SEQ ID NO:376;
(h) LCDR1, LCDR2, and LCDR3 have the amino acid sequences shown, respectively, in residues 24-34, residues 50-56, and residues 89-97 of SEQ ID NO:394; and HCDR1, HCDR2, and HCDR3 have the amino acid sequences shown, respectively, in residues 31-35, residues 50-66, and residues 99-102 of SEQ ID NO:396; or
(i) LCDR1, LCDR2, and LCDR3 have the amino acid sequences shown, respectively, in residues 24-34, residues 50-56, and residues 89-97 of SEQ ID NO:426; and HCDR1, HCDR2, and HCDR3 have the amino acid sequences shown, respectively, in residues 31-35, residues 50-66, and residues 99-107 of SEQ ID NO:428.

24. The antibody of claim 16, wherein
the $V_L$ and $V_H$ domains comprise the amino acid sequences as shown in SEQ ID NOs:170 and 172, respectively;
the $V_L$ and $V_H$ domains comprise the amino acid sequences as shown in SEQ ID NOs:242 and 244, respectively;
the $V_L$ and $V_H$ domains comprise the amino acid sequences as shown in SEQ ID NOs:278 and 280, respectively;
the $V_L$ and $V_H$ domains comprise the amino acid sequences as shown in SEQ ID NOs:306 and 308, respectively;
the $V_L$ and $V_H$ domains comprise the amino acid sequences as shown in SEQ ID NOs:322 and 324, respectively;
the $V_L$ and $V_H$ domains comprise the amino acid sequences as shown in SEQ ID NOs:330 and 332, respectively;
the $V_L$ and $V_H$ domains comprise the amino acid sequences as shown in SEQ ID NOs:374 and 376, respectively;
the $V_L$ and $V_H$ domains comprise the amino acid sequences as shown in SEQ ID NOs:394 and 396, respectively; or
the $V_L$ and $V_H$ domains comprise the amino acid sequences as shown in SEQ ID NOs:426 and 428, respectively.

25. The antibody of claim 16, wherein the antibody is selected from the group consisting of:
an antibody comprising a $V_L$ domain and a $V_H$ domain comprising the amino acid sequences as shown in SEQ ID NOs:170 and 172, respectively;
an antibody comprising a $V_L$ domain and a $V_H$ domain comprising the amino acid sequences as shown in SEQ ID NOs:242 and 244, respectively;
an antibody comprising a $V_L$ domain and a $V_H$ domain comprising the amino acid sequences as shown in SEQ ID NOs:246 and 248, respectively;
an antibody comprising a $V_L$ domain and a $V_H$ domain comprising the amino acid sequences as shown in SEQ ID NOs:278 and 280, respectively.

26. The antibody of claim 16 wherein the antibody is a single chain Fv (scFv).

27. The antibody of claim 16 wherein said antibody is a bispecific antibody that also binds to the extracellular domain of PDGFRβ.

28. A pharmaceutical composition comprising:
the antibody of claim 16; and
a pharmaceutically acceptable carrier.

29. A bispecific binding composition that neutralizes both PDGFRβ and VEGF-A, said composition comprising:
an isolated anti-PDGFRβ antibody as in claim 1; and
an isolated anti-VEGF-A antibody as in claim 16.

30. The bispecific binding composition of claim 29, wherein the anti-PDGFRβ antibody and the anti-VEGF-A antibody are covalently linked via a linker.

31. The bispecific binding composition of claim 30, wherein the linker is a polypeptide linker.

32. The bispecific binding composition of claim 29, wherein the anti-PDGFRβ and anti-VEGF-A antibodies are single chain Fvs covalently linked to form a tandem single chain Fv (tascFv) or a bi-single chain Fv (biscFv).

33. The bispecific binding composition of claim 29, further comprising a pharmaceutically acceptable carrier.

34. A bispecific antibody that neutralizes both PDGFRβ and VEGF-A, said bispecific antibody comprising:
an antigen-binding region from an anti-PDGFRβ antibody as in claim 1; and
an antigen-binding region from an anti-VEGF-A antibody as in claim 16.

35. The bispecific antibody of claim 34, wherein said bispecific antibody comprises an immunoglobulin heavy chain constant region.

36. The bispecific antibody of claim 35, wherein the immunoglobulin heavy chain constant region is an Fc fragment.

37. The bispecific antibody of claim 36, wherein the Fc fragment comprises an Fc region modified to reduce or eliminate one or more effector functions.

38. The bispecific antibody of claim 34, wherein said bispecific antibody is a tascFv, a biscFv, or a biAb.

39. A bispecific antibody that neutralizes both PDGFRβ and VEGF-A, said bispecific antibody comprising:
(I) a first antigen-binding region that specifically binds to the extracellular domain of PDGFRβ and neutralizes PDGFRβ activity, wherein said PDGFRβ-binding region binds to an epitope comprising residues 251-270 of SEQ ID NO:4, and said PDGFRβ-binding region comprises a $V_L$ domain ($V_{L\text{-}PDGFR}$) comprising CDRs $LCDR1_{PDGFR}$, $LCDR2_{PDGFR}$, and $LCDR3_{PDGFR}$ and a $V_H$ domain ($V_{H\text{-}PDGFR}$) comprising CDRs $HCDR1_{PDGFR}$, $HCDR2_{PDGFR}$, and $HCDR3_{PDGFR}$, wherein
$LCDR1_{PDGFR}$ has the amino acid sequence shown in SEQ ID NO:433;
$LCDR2_{PDGFR}$ has the amino acid sequence shown in SEQ ID NO:434;
$LCDR3_{PDGFR}$ has the amino acid sequence shown in SEQ ID NO:435;
$HCDR1_{PDGFR}$ has the amino acid sequence shown in SEQ ID NO:436;
$HCDR2_{PDGFR}$ has the amino acid sequence shown in SEQ ID NO:437;
$HCDR3_{PDGFR}$ has an amino acid sequence selected from the group consisting of SEQ ID NOs:438-442; and
(II) a second antigen binding region that specifically binds to VEGF-A and neutralizes VEGF-A activity, wherein said VEGF-A-binding region binds to an epitope comprising (a) residues 42-52 of SEQ ID NO:2 and (b) residues 72-82 of SEQ ID NO:2, and said VEGF-A-binding region comprises a $V_L$ domain ($V_{L\text{-}VEGF}$) comprising CDRs $LCDR1_{VEGF}$, $LCDR2_{VEGF}$, and $LCDR3_{VEGF}$ and a $V_H$ domain ($V_{H\text{-}VEGF}$) comprising CDRs $HCDR1_{VEGF}$, $HCDR2_{VEGF}$, and $HCDR3_{VEGF}$, wherein
$LCDR1_{VEGF}$ has the amino acid sequence shown in SEQ ID NO:448;
$LCDR2_{VEGF}$ has the amino acid sequence shown in SEQ ID NO:449;
$LCDR3_{VEGF}$ has the amino acid sequence shown in SEQ ID NO:450;
$HCDR1_{VEGF}$ has the amino acid sequence shown in SEQ ID NO:451;
$HCDR2_{VEGF}$ has the amino acid sequence shown in SEQ ID NO:452;
$HCDR3_{VEGF}$ has an amino acid sequence selected from the group consisting of SEQ ID NOs:453-461.

40. The bispecific antibody of claim 39, wherein $LCDR1_{PDGFR}$, $LCDR2_{PDGFR}$, and $LCDR3_{PDGFR}$ have the amino acid sequences shown, respectively, in residues 24-40, residues 56-62, and residues 95-103 of SEQ ID NO:46; and $HCDR1_{PDGFR}$, $HCDR2_{PDGFR}$, and $HCDR3_{PDGFR}$ have the amino acid sequences shown, respectively, in residues 31-35, residues 50-66, and residues 99-111 of SEQ ID NO:48.

41. The bispecific antibody of claim 40, wherein $LCDR1_{VEGF}$, $LCDR2_{VEGF}$, and $LCDR3_{VEGF}$ have the amino acid sequences shown, respectively, in residues 24-34, residues 50-56, and residues 89-97 of SEQ ID NO:278; and $HCDR1_{VEGF}$, $HCDR2_{VEGF}$, and $HCDR3_{VEGF}$ have the amino acid sequences shown, respectively, in residues 31-35, residues 50-66, and residues 99-110 of SEQ ID NO:280.

42. The bispecific antibody of claim 41, wherein
$V_{L\text{-}PDGFR}$ comprises the amino acid sequence as shown in SEQ ID NO:46;
$V_{H\text{-}PDGFR}$ comprises the amino acid sequence as shown in SEQ ID NO:48;
$V_{L\text{-}VEGF}$ comprises the amino acid sequence as shown in SEQ ID NO:278; and
$V_{H\text{-}VEGF}$ comprises the amino acid sequence as shown in SEQ ID NO:280.

43. The bispecific antibody of claim 41, wherein said bispecific antibody is a bi-single chain Fv (biscFv).

44. The bispecific antibody of claim 43, wherein said biscFv comprises an amino acid sequence selected from the group consisting of (i) amino acid residues 20-770 of SEQ ID NO:624, and (ii) amino acid residues 20-773 of SEQ ID NO:628.

45. The bispecific antibody of claim 39, wherein
$LCDR1_{PDGFR}$, $LCDR2_{PDGFR}$, and $LCDR3_{PDGFR}$ have the amino acid sequences shown, respectively, in residues 24-40, residues 56-62, and residues 95-103 of SEQ ID NO:6; and $HCDR1_{PDGFR}$, $HCDR2_{PDGFR}$, and $HCDR3_{PDGFR}$ have the amino acid sequences shown, respectively, in
(a) residues 31-35, residues 50-66, and residues 99-110 of SEQ ID NO:8, or
(b) residues 31-35, residues 50-66, and residues 99-110 of SEQ ID NO:12.

46. The bispecific antibody of claim 45, wherein
$LCDR1_{VEGF}$, $LCDR2_{VEGF}$, and $LCDR3_{VEGF}$ have the amino acid sequences shown, respectively, in residues 24-34, residues 50-56, and residues 89-97 of SEQ ID NO:278; and $HCDR1_{VEGF}$, $HCDR2_{VEGF}$, and $HCDR3_{VEGF}$ have the amino acid sequences shown, respectively, in residues 31-35, residues 50-66, and residues 99-110 of SEQ ID NO:280.

47. The bispecific antibody of claim 46, wherein
$V_{L\text{-}PDGFR}$ comprises the amino acid sequence as shown in SEQ ID NO:6;
$V_{H\text{-}PDGFR}$ comprises the amino acid sequence as shown in SEQ ID NO:8 or SEQ ID NO:12;
$V_{L\text{-}VEGF}$ comprises the amino acid sequence as shown in SEQ ID NO:278; and
$V_{H\text{-}VEGF}$ comprises the amino acid sequence as shown in SEQ ID NO:280.

48. The bispecific antibody of claim 46, wherein said bispecific antibody is a biAb comprising
an immunoglobulin light chain comprising $V_{L\text{-}PDGFR}$ as its $V_L$ domain; and
an immunoglobulin heavy chain comprising $V_{H\text{-}PDGFR}$ as its $V_H$ domain, wherein said heavy chain is fused at its C-terminus with a single chain Fv (scFv) comprising $V_{L\text{-}VEGF}$ and $V_{H\text{-}VEGF}$ so as to form an IgG-scFv fusion.

49. The bispecific antibody of claim 48, wherein
said immunoglobulin light chain comprises the amino acid sequence as shown in residues 20-239 of SEQ ID NO:537; and
said IgG-scFv fusion comprises an amino acid sequence selected from the group consisting of
(i) amino acid residues 20-729 of SEQ ID NO:630,
(ii) amino acid residues 20-732 of SEQ ID NO:634,
(iii) amino acid residues 20-729 of SEQ ID NO:636, and
(iv) amino acid residues 20-732 of SEQ ID NO:640.

50. A pharmaceutical composition comprising
the bispecific antibody as in claim 39; and
a pharmaceutically acceptable carrier.

51. An isolated antibody that binds to the extracellular domain of PDGFRβ and neutralizes PDGFRβ activity, said antibody comprising a $V_L$ domain comprising CDRs LCDR1, LCDR2, and LCDR3 and a $V_H$ domain comprising CDRs HCDR1, HCDR2, and HCDR3, wherein
  LCDR1, LCDR2, and LCDR3 comprise the amino acid sequences shown, respectively, in residues 24-40, residues 56-62, and residues 95-103 of SEQ ID NO:46; and
  HCDR1, HCDR2, and HCDR3 comprise the amino acid sequences shown, respectively, in residues 31-35, residues 50-66, and residues 99-111 of SEQ ID NO:48.

52. The isolated antibody of claim 51, wherein
  the $V_L$ domain comprises the amino acid sequence as shown in SEQ ID NO:46 and
  the $V_H$ domain comprises the amino acid sequence as shown in SEQ ID NO:48.

53. The isolated antibody of claim 51, wherein said antibody is a bispecific antibody that also binds to VEGF-A.

54. A pharmaceutical composition comprising the isolated antibody of claim 51 and a pharmaceutically acceptable carrier.

55. An isolated antibody that binds to VEGF-A and neutralizes VEGF-A activity, said antibody comprising a $V_L$ domain comprising CDRs LCDR1, LCDR2, and LCDR3 and a $V_H$ domain comprising CDRs HCDR1, HCDR2, and HCDR3, wherein
  LCDR1, LCDR2, and LCDR3 comprise the amino acid sequences shown, respectively, in residues 24-34, residues 50-56, and residues 89-97 of SEQ ID NO:278; and
  HCDR1, HCDR2, and HCDR3 comprise the amino acid sequences shown, respectively, in residues 31-35, residues 50-66, and residues 99-110 of SEQ ID NO:280.

56. The isolated antibody of claim 55, wherein
  the $V_L$ domain comprises the amino acid sequence as shown in SEQ ID NO:278 and
  the $V_H$ domain comprises the amino acid sequence as shown in SEQ ID NO:280.

57. The isolated antibody of claim 55, wherein said antibody is a bispecific antibody that also binds to PDGFRβ.

58. A pharmaceutical composition comprising the isolated antibody of claim 55 and a pharmaceutically acceptable carrier.

59. A bispecific antibody that neutralizes both PDGFRβ and VEGF-A, said bispecific antibody comprising:
  (I) a PDGFRβ-binding region that specifically binds to the extracellular domain of PDGFRβ and neutralizes PDGFRβ activity, wherein said PDGFRβ-binding region comprises
    $LCDR1_{PDGFR}$, $LCDR2_{PDGFR}$, and $LCDR3_{PDGFR}$ comprising the amino acid sequences shown, respectively, in residues 24-40, residues 56-62, and residues 95-103 of SEQ ID NO:46; and
    $HCDR1_{PDGFR}$, $HCDR2_{PDGFR}$, and $HCDR3_{PDGFR}$ comprising the amino acid sequences shown, respectively, in residues 31-35, residues 50-66, and residues 99-111 of SEQ ID NO:48; and
  (II) a VEGF-A-binding region that specifically binds to VEGF-A and neutralizes VEGF-A activity, wherein said VEGF-A-binding region comprises
    $LCDR1_{VEGF}$, $LCDR2_{VEGF}$, and $LCDR3_{VEGF}$ comprising the amino acid sequences shown, respectively, in residues 24-34, residues 50-56, and residues 89-97 of SEQ ID NO:278; and
    $HCDR1_{VEGF}$, $HCDR2_{VEGF}$, and $HCDR3_{VEGF}$ comprising the amino acid sequences shown, respectively, in residues 31-35, residues 50-66, and residues 99-110 of SEQ ID NO:280.

60. A bispecific antibody that neutralizes both PDGFRβ and VEGF-A, said bispecific antibody comprising:
  (I) a PDGFRβ-binding region that specifically binds to the extracellular domain of PDGFRβ and neutralizes PDGFRβ activity, wherein said PDGFRβ-binding region comprises a $V_L$ domain ($V_{L-PDGFR}$) and a $V_H$ domain ($V_{H-PDGFR}$), wherein
    $V_{L-PDGFR}$ comprises the amino acid sequence as shown in SEQ ID NO:46;
    $V_{H-PDGFR}$ comprises the amino acid sequence as shown in SEQ ID NO:48; and
  (II) a VEGF-A-binding region that specifically binds to VEGF-A and neutralizes VEGF-A activity, wherein said VEGF-A-binding region comprises a $V_L$ domain ($V_{L-VEGF}$) and a $V_H$ domain ($V_{H-VEGF}$), wherein
    $V_{L-VEGF}$ comprises the amino acid sequence as shown in SEQ ID NO:278; and
    $V_{H\ VEGF}$ comprise the amino acid sequences as shown in SEQ ID NO: 280.

61. A pharmaceutical composition comprising the isolated antibody of claim 59 and a pharmaceutically acceptable carrier.

* * * * *